(12) United States Patent
Neibergs et al.

(10) Patent No.: US 9,133,519 B2
(45) Date of Patent: Sep. 15, 2015

(54) COMPOSITIONS AND METHODS FOR DIAGNOSIS OF GENETIC SUSCEPTIBILITY, RESISTANCE, OR TOLERANCE TO INFECTION BY MYCOBACTERIA AND BOVINE PARATUBERCULOSIS USING PROMOTER VARIANTS OF EDN2

(71) Applicant: Washington State University, Pullman, WA (US)

(72) Inventors: Holly L. Neibergs, Palouse, WA (US); Ricardo Zanella, Rio Grande do Sul (BR); Jeremy F. Taylor, Columbia, MO (US); Zeping Wang, Pullman, WA (US); Erik Scraggs, Pullman, WA (US); Stephen N. White, Pullman, WA (US); Robert Schnabel, Columbia, MO (US); Curtis P. Van Tassell, Ellicott City, MD (US)

(73) Assignees: WASHINGTON STATE UNIVERSITY, Pullman, WA (US); UNIVERSITY OF MISSOURI, Columbia, MO (US); THE UNITED STATES OF AMERICA, AS REPRESENTED BY THE SECRETARY OF AGRICULTURE, Washington, DC (US)

( * ) Notice: Subject to any disclaimer, the term of this patent is extended or adjusted under 35 U.S.C. 154(b) by 273 days.

(21) Appl. No.: 13/838,877

(22) Filed: Mar. 15, 2013

(65) Prior Publication Data

US 2014/0283151 A1    Sep. 18, 2014

(51) Int. Cl.
*A01K 67/00* (2006.01)
*C12N 15/00* (2006.01)
*C12Q 1/68* (2006.01)

(52) U.S. Cl.
CPC ........ *C12Q 1/6883* (2013.01); *C12Q 2600/118* (2013.01); *C12Q 2600/124* (2013.01); *C12Q 2600/156* (2013.01)

(58) Field of Classification Search
None
See application file for complete search history.

(56) References Cited

U.S. PATENT DOCUMENTS

2010/0223687 A1*   9/2010   Neibergs et al. ................ 800/22

* cited by examiner

*Primary Examiner* — Michael Burkhart
(74) *Attorney, Agent, or Firm* — Whitham, Curtis, Christofferson & Cook, P.C.

(57) ABSTRACT

Provided are methods for determining susceptibility, resistance or tolerance to *Mycobacterium avium* subspecies *paratuberculosis* (Map) infection, comprising: determining, using a biological sample from a m

US 9,133,519 B2

COMPOSITIONS AND METHODS FOR DIAGNOSIS OF GENETIC SUSCEPTIBILITY, RESISTANCE, OR TOLERANCE TO INFECTION BY MYCOBACTERIA AND BOVINE PARATUBERCULOSIS USING PROMOTER VARIANTS OF EDN2

STATEMENT REGARDING FEDERALLY-SPONSORED RESEARCH

This invention was made with government support under grant No. 2008-55620-18710 from the United States Department of Agriculture (USDA) and the National Institute of Food and Agriculture (NIFA). The Government has certain rights in the invention.

TECHNICAL FIELD

The invention relates generally to genome-wide association studies to identify genetic loci associated with susceptibility, resistance or tolerance to disease, and in more particular aspects to identifying causative bovine genetic loci associated with susceptibility, resistance or tolerance to infection by *Mycobacteria* and *Paratuberculosis*, and to compositions and methods for diagnosis thereof. Certain aspects relate to methods comprising determination of a presence or absence of a causative mutation, or the genotype of a single nucleotide polymorphism (SNP) within the Endothelin 2 (EDN2) gene that segregates with resistance or tolerance to *Mycobacterium avium* subspecies *paratuberculosis* (Map) tissue infection in, for example, Holstein and Jersey cattle. Additional aspects relate to culling, and/or selecting and/or selective breeding of mammals based on the methods. Further aspects to animals derived by culling, and/or selecting and/or selective breeding of mammals based on the methods. Yet additional aspects relate to methods of selectively procuring a mammal for commercial use.

SEQUENCE LISTING

A Sequence Listing comprising SEQ ID NOS:1-124, has been provided in computer readable form (.txt) as part of this application, and is incorporated by reference herein in its entirety as part of this application.

BACKGROUND

Bovine *Paratuberculosis*, commonly referred to as Johne's disease, is a contagious bacterial disease estimated to be present in 68.1% of U.S. dairy herds (APHIS 2008) and results in annual losses exceeding U.S. $200 million (Ott et al. 1999). The bacterium *Mycobacterium avium* subspecies *paratuberculosis* (Map) is responsible for Johne's disease and causes reduced milk production, reproductive failure, weight loss, and eventual death. Johne's disease is not treatable, and vaccination against Map has been largely unsuccessful.

Because effective diagnosis, treatment and management strategies for Johne's disease are difficult and expensive to implement, a complementary strategy to reduce the susceptibility of cattle to Johne's disease is through improving host genetics through selective breeding. Susceptibility to Map infection in cattle is heritable, with heritability estimated to range from 0.06 to 0.183 (Koets et al. 2000; Mortensen et al. 2004; Gonda et al. 2006). Breed-specific differences in susceptibility have also been reported, with Jersey and Shorthorn breeds being more susceptible than Holstein (Cetinkaya et al. 1997; Jakobsen et al. 2000). These results indicate that susceptibility to Map infection is at least partially determined by inherent genetic factors, and that breeding for increased resistance to Johne's disease may be possible.

The identification of animals with genetic susceptibility, resistance, or tolerance to infection by Map would provide mechanisms to reduce the incidence of Johne's disease. Further, a reduction of Map in the environment may also be beneficial to humans, as the presence of Map has also been implicated in the etiology of Crohn's disease (Bentley et al. 2008). It has been demonstrated that the genetic background of an animal plays a role in its resistance to Johne's disease (Settles et al., 2009). Cattle that are exposed to *Mycobacterium avium* subspecies *paratuberulosis* (Map) respond by either resisting or clearing the infection or becoming chronically infected with varying levels of disease severity.

Resistance or susceptibility to Map infection has been shown to have a hereditary component in cattle and mice (Koets et al. 2000; Mortensen et al. 2004; Gonda et al. 2006; Hinger et al. 2008), with estimates ranging from 0.06 to 0.102. However, attempts to locate genetic loci associated with resistance to *paratuberculosis* have had limited success. Gonda et al. (2007) found evidence for a quantitative trait locus (QTL) on *Bos taurus* chromosome 20 (BTA20) associated with *paratuberculosis* susceptibility. Hinger et al. (2007) investigated the association with *paratuberculosis* of 8 microsatellites located in or near Map susceptibility candidate genes in 1,179 (594 positive) German Holstein cows. However, none showed any significant associations. While Map susceptibility genes have yet to be identified in the bovine, Reddacliff et al. (2005) found an association of one microsatellite allele in SLC11A1 (formerly NRAMP1) with Map resistance in sheep.

Resistance to Map has been shown in mice to be associated with the Bcg gene or nramp1 which encodes the natural resistance-associated macrophage protein (Frelier et al. 1990; Skamene, 1989; Skamene et al. 1982). C57/B6 and BALB/c mice have the susceptible allele of Bcg and are susceptible to Map infections, while the C3H/HeJ strain is resistant to Map (Veazey et al. 1995a; Veazey et al. 1995b; Tanaka et al. 1994; Chiodini et al. 1993; Chandler 1962; Tanaka et al. 1994). In cattle, Map-susceptible Holstein sire lines have been found to be infected twice as often as resistant lines (Gonda et al. 2006). Heritability studies have been conducted on the presence or absence of disease based on postmortem tissue, ELISA and combined ELISA-fecal culture tests. In a Dutch study, the heritability of *paratuberculosis* infection was evaluated among vaccinated and unvaccinated animals based on findings from postmortem examinations (Koets et al. 2000). A heritability of 0.09, 0.01 and 0.06 was found for vaccinated, unvaccinated and all cows, respectively. A second study estimated the heritability of antibody response using a bivariate model with daily milk yield and optical density values from milk ELISAs (Mortensen et al. 2004). Mortensen and coworkers (2004) estimated the heritability to be 0.102 with the bivariate model and 0.091 when a sire model was used. Gonda and colleagues (2006) estimated the heritability of Johne's disease to be 0.153 based on fecal culture diagnostic testing, 0.159 based on ELISA and 0.102 from the combined antibody and fecal culture tests. We (Zanella et al. 2008) estimated the heritability of tolerance to Johne's disease to be 0.09.

Limited investigations have been conducted to identify loci associated with Johne's disease. Using a candidate gene approach, Taylor and colleagues (2006) evaluated the allele frequencies of a functional candidate gene, CARD15, in 30 unrelated unaffected animals and 11 affected animals without finding evidence for an association. Hinger et al. (2007) also investigated the association with Johne's disease utilizing 8 microsatellite genetic markers located in or near Map susceptibility candidate genes in 1,179 (594 positive) German Holstein cows, but none of the microsatellites revealed any associations. Reddacliff et al. (2005) found an association of one microsatellite allele in SLC11A1 (formerly NRAMP1) with Map resistance in sheep.

Gonda and coworkers (2006) undertook a genome-wide linkage study using ELISA, fecal culture or both to diagnose infected animals. In this study, microsatellites were used to genotype three half-sib families. The number of informative (useful) markers ranged from 151-176 within the three families. Genotypes of "positive" and "negative" animals were pooled and allele frequencies were estimated. Eight chromosomal regions were associated with the pooled samples (bovine chromosomes 7, 10, 12, 14, 15, 18, 20 and 25). The eight chromosomal regions associated with Map infection in pooled genotypes were further tested. Individual genotypes of the daughters were determined for 3-5 microsatellites within 15 cM (an estimated 15 million base pairs) of the markers identified in the pooled samples. Subsequently, only chromosome 20 was found to be linked (P=0.0319) in a chromosome-wide analysis in one of the sire families.

Several studies have addressed the identification of genetic loci associated with Map susceptibility by testing candidate genes, by genome-wide linkage or association studies. Polymorphisms in functional candidate genes, SLC11A1 (Pinedo et al. 2009a), TLR1, 2 and 4, (Mucha et al. 2009), CARD15 (Pinedo et al. 2009b), PGLYRP1 (Pant et al. 2010), IL12R (Pant et al. 2011), and IL10Ra (Verchoor et al. 2010) have been reported to be associated with susceptibility to Map infection in cattle. Genome wide linkage analysis provided evidence for a locus for Map susceptibility on BTA20 (Gonda et al. 2007). Recently, several genome wide association studies using a single nucleotide polymorphism (SNP) panel (the Illumina BovineSNP50 BeadChip) identified regions on different chromosomes that are significantly associated with Map infection (Settles et al. 2009; Minozzi et al. 2010; Kirkpatrick et al. 2010; van Hulzen et al. 2011; Minozzi et al. 2012). However, none of these publications present evidence for strong functional candidate genes associated with Johne's disease in these chromosomal regions.

Previous studies have identified several loci associated with Map tissue infection on BTA3 (Settles et al. 2009, Neibergs et al. 2010). The region associated with tissue infection was further refined to a 10.6 kb region (Zanella et al. 2011).

Current management practices are to cull cows after either testing positive for Map or exhibiting clinical signs of the disease. However, clinical signs of Map infection may be delayed as long as four to five years after the initial exposure. Current diagnostic testing has a limited sensitivity for detecting the presence of Map in pre-clinical animals, at which time they are likely to be spreading Map to other animals in the herd through fecal contamination of the environment, food, and water. The low overall sensitivity of ELISA (7-35%) and fecal (38-65%) diagnostic tests and the long incubation period of the disease present major roadblocks to the control of Johne's disease (Whitlock et al. 2000; McKenna et al. 2005; Collins et al. 2006).

Identifying the mutations associated with Map tissue infection will not only provide the opportunity to better understand the genes and gene regulatory elements that are associated with the first event in the pathogenic process that culminates in Johne's disease, but will provide compositions and methods for diagnosis of susceptibility, resistance and/or tolerance to infection by *Mycobacterium avium* subspecies *paratuberculosis* (Map).

SUMMARY OF EXEMPLARY EMBODIMENTS

Applicants herein identify and disclose mutations and genes associated with Map tissue infection, the first event in the pathogenic process that culminates in Johne's disease. Provided are compositions and methods for diagnosis of susceptibility, resistance and/or tolerance to infection by *Mycobacterium avium* subspecies *paratuberculosis* (Map).

Particular aspects, shown herein under working Example 4, for the first time identify causal variants for Map tissue infection in cattle. Re-sequencing, comparative and fine mapping of a 70 kb region on BTA3 in both Holstein and Jersey cattle was undertaken, identifying 18 candidates of functional single nucleotide polymorphisms associated with Map tissue infection (P<0.01).

According to particular aspects, a strong association (P<$9.9 \times 10^{-5}$) was located in the 3'-UTR of EDN2 whereas remaining associations were 5' to EDN2. Two microRNAs (miR-1197 and miR-2339) could bind to the SNIP site located at the 3'-UTR of EDN2, but the microRNA interference assay and mRNA stability assay showed that this SNP had no effect on EDN2 stability and expression.

According to additional aspects, screening of other variants by electrophoretic mobility shift assay indicated that two SNPs located in the promoter region of EDN2 displayed different binding affinity to nuclear proteins based on the alleles of the SNPs.

According to further aspects, these two SNPs have the allelic differences of G/T and A/G located at -671 bp and -11 kb upstream of the coding region of EDN2, respectively. A luciferase reporter assay confirmed that the transcriptional activity of the EDN2 promoter was significantly increased with the G allele at -671 bp upstream of coding region of EDN2.

According to further aspects, therefore, at least one functional variants (e.g., SNPs having the allelic differences of G/T and A/C located at -671 bp and -11 kb upstream of the coding region of EDN2, respectively) located in the promoter of EDN2 is a causal variant that results in susceptibility to Map tissue infection leading to Johne's disease.

Particular aspects provide a method for determining at least one of susceptibility, resistance or tolerance to *Mycobacterium avium* subspecies *paratuberculosis* (Map) infection of a subject, comprising: determining, using a biological sample from a mammalian subject, a presence or absence of at least one EDN2 gene mutation, or the genotype of at least one EDN2 gene single nucleotide polymorphism (SNP) selected from the SNP group consisting of SNP105 (nucleotide position 105,288,174 on BTA3 (UMD 3.1)), SNP208 (nucleotide position 105,298,664 on BTA3 (UMD 3.1)), and SNP272 (nucleotide position 105,305,070 bp on BTA3 (UMD 3.1)), that segregates with resistance and/or tolerance to Map tissue infection; and determining, based thereon, at least one of susceptibility, resistance or tolerance of the mammalian subject to Map infection. In certain embodiments, determining is of the genotype of the at least one EDN2 gene single nucleotide polymorphism (SNP), wherein with respect to SNP105 is of an infection susceptible allele (A) and a non-susceptible allele (G), and/or wherein with respect to SNP208 is of an infection susceptible allele (T) and a non-susceptible allele (G), and/or wherein with respect to SNP272 is of an infection susceptible allele (A) or a non-susceptible allele (G). In certain aspects, the genotypes of at least two of the SNPs are determined. In certain embodiments, the genotypes of both SNP105 and SNP208 are determined. In certain embodiments, the genotypes of SNP105. SNP208 and SNP272 are determined. Preferably, at least one of resistance or tolerance of the mammalian subject to Map infection is determined. Preferably, the mammalian subject is bovine.

Particular embodiments of the above methods further comprise at least one of culling, selecting, or breeding, based on the determining of at least one of susceptibility, resistance or tolerance of the mammalian subject to Map infection. Preferred embodiments comprise selective breeding, based on the methods, to produce offspring having at least one of susceptibility, resistance or tolerance to Map infection. In particular aspects, the methods comprise selective breeding to produce offspring having at least one of resistance or tolerance to Map infection.

Particular embodiments of the above methods further comprise determining the genotype of at least one SNP selected from the SNP group consisting of SNP28 (105,279,109; BTA3 (UMD 3.1), SNP30 (105,279,358; BTA3 (UMD 3.1), SNP66 (105,284,915; BTA3 (UMD 3.1), SNP78 (105,286,393; BTA3 (UMD 3.1), SNP80 (105,286,650; BTA3 (UMD 3.1), SNP109 (105288737; BTA3 (UMD 3.1), SNP128 (105,291,541; BTA3 (UMD 3.1), SNP137 (105,291,983; BTA3 (UMD 3.1), SNP146 (105,292,844; BTA3 (UMD 3.1), SNP170 (105,295,131; BTA3 (UMD 3.1), SNP180 (105,296,189; BTA3 (UMD 3.1), SNP181 (105,296,223; BTA3 (UMD 3.1), SNP183 (105,296,667; BTA3 (UMD 3.1), SNP190 (105,297,461; BTA3 (UMD 3.1), and SNP264 (105,304,227; BTA3 (UMD 3.1).

In particular embodiments of the above methods, the genotypes of at least three single nucleotide polymorphisms (SNPs) are determined. Certain embodiments of the above methods comprise additionally determining the genotype of at least one SNP selected from the SNP group listed in Tables 3A and 3B herein.

In certain embodiments of the above methods, determining is of the genotype of the at least one EDN2 gene single nucleotide polymorphism (SNP) that is a causative SNP.

Additional aspects provide a mammal derived by at least one of culling, and/or selecting, and/or selective breeding, based on the determining of resistance and/or tolerance of the mammalian subject to Map infection according to the method of any the methods disclosed herein. In particular aspects, the mammal is bovine. In certain embodiments, the mammal comprises non-susceptible alleles of SNP105 (G), SNP208 (G), and SNP272 (G).

In particular aspects of the methods disclosed herein, with respect to SNP105 the non-susceptible allele is (G), with respect to SNP208 the non-susceptible allele is (G), and with respect to SNP272 the non-susceptible allele is (G). In particular aspects the mammal is bovine (e.g., Holstein or Jersey).

Further provided are methods for selectively procuring or selling a mammal for commercial use, comprising: determining whether a mammal to be procured or sold has been subjected to a method for determining at least one of susceptibility, resistance or tolerance to *Mycobacterium avium* subspecies *paratuberculosis* (Map) infection of a subject, comprising determining, using a biological sample from a mammalian subject, a presence or absence of at least one EDN2 gene mutation, or the genotype of at least one EDN2 gene single nucleotide polymorphism (SNP) selected from the SNP group consisting of SNP105 (nucleotide position 105,288,174 on BTA3 (UMD 3.1)), SNP208 (nucleotide position 105,298,664 on BTA3 (UMD 3.1)), and SNP272 (nucleotide position 105,305,070 bp on BTA3 (UMD 3.1)), that segregates with resistance and/or tolerance to Map tissue infection, and determining, based thereon, at least one of susceptibility, resistance or tolerance of the mammalian subject to Map infection; and procuring, not procuring, selling or not selling the mammal based on the genotype of at least one EDN2 gene SNP. In particular aspects, procurement or non-procurement is based on the presence of at least one non-susceptible allele selected from the SNP group consisting of SNP105 (G), SNP208 (G), and SNP272 (G). In certain aspects, non-procurement or non-selling is based on the absence of at least one non-susceptible allele selected from the SNP group consisting of SNP105 (G), SNP208 (G), and SNP272 (G).

DETAILED DESCRIPTION OF EXEMPLARY EMBODIMENTS

Johne's disease is a highly transmissible bacterial disease, caused by *Mycobacterium avium* subspecies *paratuberculo-*

*sis* (Map). The objective of this study was to identify putative causative mutations responsible for the association of Map tissue infection in Holstein and Jersey cattle. To determine this, we performed re-sequencing of this region in Jersey and Holstein cattle. Re-sequencing identified 528 SNPs. These were further evaluated by comparing conservation of the DNA sequence variants across species for known functional motifs. An assay was developed to test the association of 96 SNPs that were either highly conserved or provided evidence of possible functional differences between alleles. Eighteen SNPs associated with Map tissue infection were tested for putative functional differences by electrophoretic mobility shift assays. Two SNPs were identified to alter the binding activities of nuclear proteins. These changes also increased transcriptional activity of a luciferase reporter construct, which was consistent with the mobility shift changes. These findings agree with other studies suggesting that the majority of causative mutations are due to alterations in gene expression regulation. It is still under investigation as to the genes that are regulated by these transcription binding factors. The selection of animals that are less susceptible to Map tissue infection provides a complementary approach to reduce the prevalence of Johne's disease in dairy cattle.

Previously a whole genome association analysis identified markers and loci associated with *Mycobacterium avium* subsp. *Paratuberculosis* infection status in U.S. Holstein cattle. More specifically, a genome-wide association study was previously undertaken by Applicants' research group, which identified a 70 kb region on BTA3 as being associated with Map tissue infection.

Figure 17:
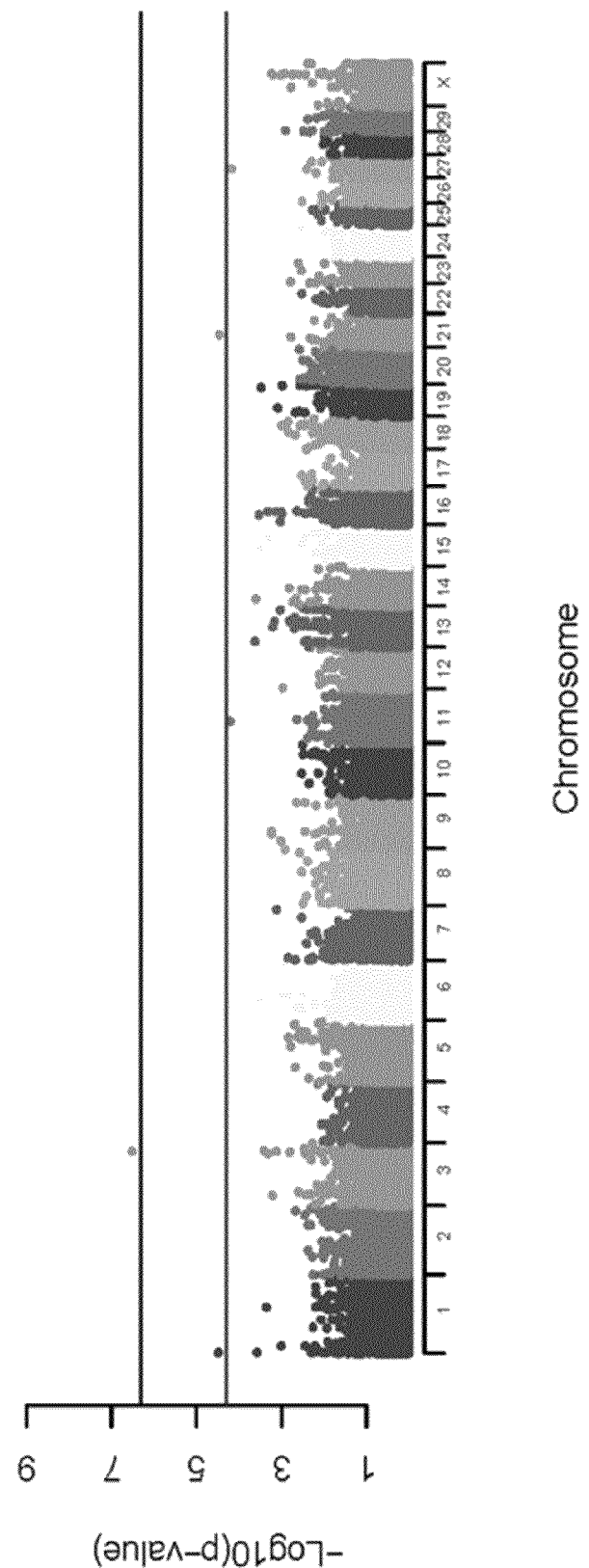
FIG. 17 shows a genome-wide plot of $-\log_{10}$(p-values) for an association of loci with Map infected tissue (tissue positive versus tissue negative). Chromosomes 1 through 30 and Chromosome X are shown separated by grey scale. The horizontal dark grey line is drawn at $-\log 10(5 \times 10^{-5})$ and the horizontal black line is drawn at $-\log 10(5 \times 10^{-7})$ to show those significant at the moderate and strong levels of significance, respectively.

Specifically, as disclosed under working EXAMPLE 1 herein below, a GWA study was conducted to identify loci associated with Map infection status using four different case/control classifications of the samples: presence of Map in tissue; presence of Map in feces; presence of Map in tissue, but not feces; and the presence of Map in both tissue and feces. Results from the first classification, presence of Map in tissue, produced a single strong association ARS-BFGL-NGS-113303 (MAF=0.36, Bonferroni p=0.014) with resistance to Map penetration of the tissue and 4 moderate associations (FIG. 17). RefSeq genes located within 1 Mb of ARS-BFGL-NGS-113303 identified the gene endothelin 2 (EDN2) located 31 Kb downstream from ARS-BFGL-NGS-113303. EDN2 has been found to be highly expressed in the gastrointestinal tract of the mouse. Takizawa et al. (2005) found that in intestinal epithelial cells EDN2 could be secreted into the lamina propria and the dome region in Peyer's patch, and that it might modulate immune cells for mucosal defense. Further, McCartney et al. (2002) found EDN2 to be highly expressed in mucosal biopsies of humans, including samples taken from patients with inflammatory bowel disease (i.e., Crohn's disease). However, no associations were found between human IBD and mRNA expression.

Figure 18:
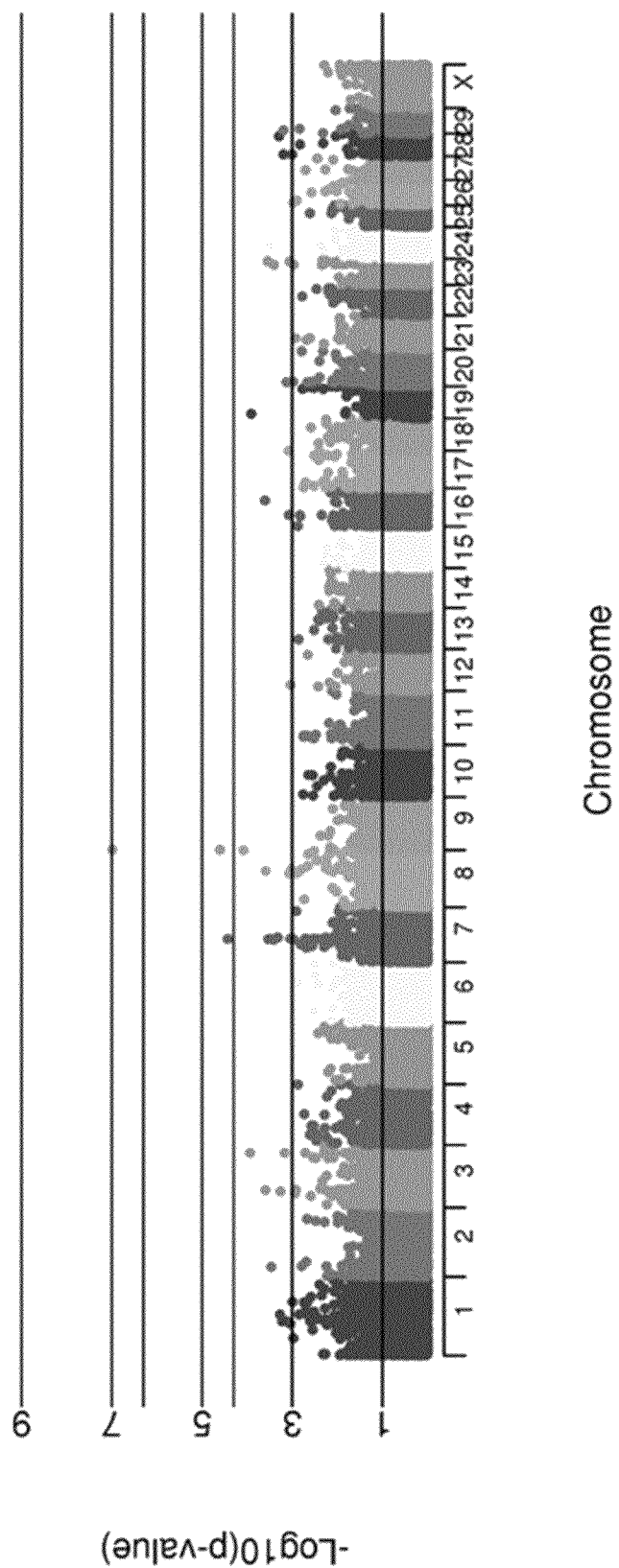
FIG. 18 shows genome-wide plot of $-\log_{10}$(p-values) for an association of loci with Map tissue infected and fecal positive phenotype (clinical). Chromosomes 1 through 30 and Chromosome X are shown separated by grey scale. The horizontal dark grey line is drawn at $-\log 10(5 \times 10^{-5})$ and the horizontal black line is drawn at $-\log 10(5 \times 10^{-7})$ to show those significant at the moderate and strong levels of significance, respectively.

Association with the presence of Map in feces, however, did not yield any strong associations and only 4 moderate associations, 3 of which were on different chromosomes to those identified as associated with Map infection of tissue. The fourth locus, on chromosome 5, was 30 Mb from the SNP found to be moderately associated with Map infection of tissue. Comparing the rank order of SNPs, by significance, for the tissue positive results to the fecal positive results showed the two to have a significantly different significance ordering (data not shown). It is well established that the sensitivity of Map fecal culture in the early stages of infection is low. In this study, fecal culture only detected the presence of Map infection 40% of the time in the presence of tissue infection. This result shows that the differences in sensitivities between the diagnostic tests and the resulting definition of phenotype significantly impacts the loci detected to be associated with Map and their corresponding interpretation. This result led to the question of whether there was a difference in loci associated with a tissue positive, but fecal negative classification and a tissue positive and fecal positive classification. If having fecal culture results provides no additional information, one would expect the rank order of SNPs, by significance, to be similar in these analyses. However, this is not what was found. Results from tissue infection with no fecal shedding did not identify any strongly associated regions and only 3 moderately associated regions, which included the same SNP found to have a strong association (ARS-BFGL-NGS-113303) to tissue positive culture. Results from the analysis of the tissue positive infection in conjunction with fecal shedding phenotype produced one strong association on chromosome 9 (BTB-01957421, MAF=0.01, Bonferonni p=0.005) and 4 moderate associations, 3 of which were neighbors of BTB-01957421 (FIG. 18). There are no Bovine RefSeq genes within 1 Mb of BTB-01957421. The identification of different loci associated with tissue infection, compared to tissue infected and fecal shedding, indicates that there are loci important to different stages of the disease.

The infection of cells by Map is the first step toward Johne's disease, but it may not be a guarantee of disease. Similarly, fecal shedding of Map may occur because of environmental exposure, but without tissue infection the animal may not become diseased. Within hours of Map ingestion, the bacterium attaches to the host's intestinal mucosa and penetrates the mucosa/M cells overlying Peyer's patches (Wu et al. 2007; Momotani et al. 1988). Map that survive phagocytosis by macrophages acquire nutrients for growth and replicate. Map is later disseminated in macrophages and is associated with early paucibacillary lesions. This cell-mediated immunological response restricts the expansion of Map (Clarke 1997; Waters et al. 1999). At this stage, and depending on other factors (such as the dose of Map, the genetics of the host, local tissue cytokine concentrations, stress, and hormone levels of the cow) the animal may either clear Map or may develop a persistent Map infection that culminates in Johne's disease (Harris and Barletta 2001). For those animals that progress to Johne's disease, humoral-mediated responses replace cell-mediated responses. These animals exhibit fecal shedding, positive serological tests, greater Map replication rates, multibacillary lesions, and clinical disease (Whittington and Sergeant, 2001). The very different processes involved in early disease and late disease may also be reflected in the different loci found to be associated with the classification of tissue infection as compared to clinical infection. Because the etiology of the disease is not fully understood, loci associated with tissue infection or the "clinical" diagnosis are not referred to as Johne's susceptibility or resistance loci, as these loci may have different roles in the pathogenesis of Johne's disease at different stages. Therefore, the use of both tissue and fecal diagnostic testing provides a more complete profile of the health status of the cow.

While others have found evidence of association with Johne's disease on bovine chromosome 20 (BTA20), the present study shows no evidence for a locus associated with Johne's disease on BTA 20 in any of the four phenotype classifications analyzed. Additionally, in the Crohn's disease literature two genes consistently have the most significant association with Crohn's: IL23R and NOD2 (also known as CARD15). While others have shown NOD2 to have "no association" with Johne's disease (Taylor et al. 2006), no one has yet looked at the IL23R ortholog on bovine chromosome 3

(located at 83 Mb). Focusing on all SNPs within 1 Mb of both NOD2 and IL23R, no loci in the vicinity of these genes were found to be associated with any Map infection phenotype (data not shown).

As disclosed under working EXAMPLE 1 herein below, the loci associated with tolerance to Johne's disease in cattle were examined. One critical reason for doing genome-wide studies is in the characterization of the phenotype. In working EXAMPLE 2 the phenotype was defined as tolerance to bovine *paratuberculosis*. The definition of tolerance was that animals that were infected had high doses of Map in the tissues but lower levels of Map in the feces. Once the animal becomes infected it can spread the Map to other animals through the fecal material (Harris and Barletta 2001). The ability to reduce the spreading of the disease by having low doses of Map in the feces, in comparison with the levels of Map in the tissue, was characterized as tolerance. Because tolerance can only be measured in infected animals (tissue positive), and fecal shedding occurs after a long incubation period, the age of infection and infection pressure could play an important role in the definition of tolerance. From the data a small negative correlation was observed between infection and age ($r=-0.09$) or fecal shedding and age ($r=-0.18$), indicating no effect of age with disease status. Using the culture of tissue as a method to identify the true disease status of the animals reduced the misclassification of the phenotype in animals with early disease frequently found when animals were diagnosed using fecal culture or ELISA (Sockett et al. 1992, Whitlock et al. 1996, 2000).

Traits, including most diseases, are distributed as quantitative traits and usually determined by complex genetic and environmental factors and potentially gene-gene interactions and gene-environment interactions (Li et al. 2006). In many cases of complex diseases, the infectious status of the animal is characterized as some threshold value (Churchill and Doerge, 1994). The use of genome-wide association studies with a quantitative trait provides relevant information of genetic variation associated with disease. A limiting factor often faced in the case-control association studies is the limited sample size. One alternative to reduce the effects of the small number of cases and controls is to analyze tolerance as a quantitative trait, in this case including all the positive animals with a tolerance index. The peak $CFU_t$ and average $CFU_t$ were highly correlated with peak $CFU_f$ and average fecal $CFU_f$ ($r=0.73$ and $r=0.79$, respectively).

In a review article, Abubakar and colleagues (2008) suggested that there is sufficient evidence for the presence of *Mycobacterium avium* subspecies *paratuberculosis* in the gut of patients with Crohn's disease. A summary risk difference of 0.23 (95% CI, 0.14-0.32) was calculated, which remained consistent after sensitivity analysis excluding various sets of studies, and suggested an association with Johne's disease. Consequently, the persistence of intolerant animals on the farm will help to spread the disease and consequently may increase the incidence of Crohn's disease in humans. None of our SNPs were located close to genomic regions known to be associated with Crohn's disease in humans. However, one SNP located on BTA 15 was localized 522 kb from the gene Interleukin-18 (IL18), which is a proinflammatory cytokine and considered to be a key factor in inflammatory bowel diseases (IBD) (Banerjee and Bond, 2008). This SNP is also located 428 kb from the PTS gene. Mutations in PTS result in serotonin and catecholamine deficiency that affect a range of immune responses involving cytokines, lytic activity, and antibody production (Thong and Blau 1997, Alaniz et al. 1999).

The SNP associated with $T_{Average}$ residing on BTA 2 is located 45 kb from CXCR4, and 188 Kb from MCM6. The inhibition of the activity of CXCR4 with AMD3100 decreases invasion of human colorectal cancer cells in vitro (Li et al. 2008). MCM6 has been associated with lactose intolerance and also with the recurrence of squamous papillary tumor (SP) (Xu et al. 2007; Imtiaz et al. 2007).

In summary of Applicants' prior work, Loci associated with *Mycobacterium avium* subspecies *paratuberculosis* (Map) infection status in US Holsteins were identified using a whole genome SNP (single nucleotide polymorphism) assay (Illumina BovineSNP50 BeadChip™). Two hundred forty-five cows from dairies in New York, Pa., and Vermont were followed to culling between January 1999 and November 2007 and subsequently were assessed for the presence of Map in both fecal samples and necropsy tissue. An animal was considered tissue-infected if any sample contained at least one colony-forming unit per gram of tissue (cfu/g) and the same definition was employed for fecal samples ach animal was genotyped with the Illumina BovineSNP50 BeadChip. After quality assurance filtering, 218 animals and 45,683 SNPs remained. Genetic loci associated with the following four different case/control classifications were identified: presence of Map in the tissue; presence of Map in feces; presence of Map in both tissue and feces; and presence of Map in tissue but not feces. A case-control genome wide association study (GWA) was conducted to test the four different classifications of Map infection status (Cases) when compared to a Map negative control group (Control). Regions on chromosomes 1, 5, 7, 8, 16, 21, and 23 were identified that showed a moderate significance ($P<5\times10^{-5}$). Regions on chromosomes 3 and 9 were identified with a high level of association to the presence of Map in tissue and both tissue and feces, respectively ($P<5\times10^{-7}$, genome-wide Bonferonni $P<0.05$).

In particular aspects, a 255,586 bp region (SEQ ID NO:1) of bovine chromosome 3, referred to herein at the inventive "Map infection linkage disequilibrium region" is associated with Map tissue infection ($P=7\times10^{-8}$), and is further characterized as including three potentially functionally relevant genes: HIVEP3 (Human immunodeficiency virus type I enhancer-binding protein 3) (SEQ ID NO:2); EDN2 (Endothelin 2) (SEQ ID NO:3); and LOC521287 (*Bos taurus* similar to forkhead box O6) (SEQ ID NO:4), and the respective coding transcripts (SEQ ID NOS:5, 6 and 7, respectively), and polypeptides (SEQ ID NOS:8, 9 and 10, respectively).

Particular aspects provide genetic markers (single nucleotide polymorphisms or SNPs) identified within a 76 kb region (SEQ ID NO:46) on chromosome 3 that can be used to predict resistance to Map tissue infection in Holstein cows ($P=7\times10^{-8}$, $P=9\times10^{-7}$, $P=1.2\times10^{-5}$, $P=0.0006$), and thus resistance of animals to Johne's disease.

Certain aspects provide a method for determining at least one of susceptibility, resistance or tolerance to *Mycobacterium avium* subspecies *paratuberculosis* (Map) infection of a subject, comprising: obtaining a biological sample from a mammalian subject; determining, using the biological sample, a presence or absence of at least one mutation, or the genotype of at least one single nucleotide polymorphism (SNP) within Map infection linkage disequilibrium region SEQ ID NO:46 that segregates with resistance and/or tolerance to Map tissue infection, or determining a presence or absence of at least one mutation or a genotype of at least one SNP within a Map infection linkage disequilibrium region (SEQ ID NO:1) that is in linkage disequilibrium with the presence or absence of the at least one mutation or with the genotype of the at least one SNP within SEQ ID NO:46; and determining, based thereon, at least one of susceptibility, resistance or tolerance of the mammalian subject to *Mycobacterium avium* subspecies *paratuberculosis* (Map) infection.

Additional aspects provide a method for determining at least one of susceptibility, resistance or tolerance to *Mycobacterium avium* subspecies *paratuberculosis* (Map) infection of a subject, comprising: obtaining a biological sample from a mammalian subject; analyzing, using the biological sample, a mammalian genotype to determine if the genotype comprises at least one single nucleotide polymorphism (SNP) associated with at least one of susceptibility, resistance or tolerance to *Mycobacterium avium* subspecies *paratuberculosis* (Map), wherein the SNP is at least one selected from the SNP group consisting of, relative to the sequence of accession no. NC_007301.3, SNPs at positions 111,606,781, 111, 610, 137, 111, 611, 773, 111, 623,092 and 111,682,511 (ARS-BFGL-NGS-113303); and determining, based thereon, at least one of susceptibility, resistance or tolerance of the mammalian subject to *Mycobacterium avium* subspecies *paratuberculosis* (Map) infection.

Further aspects provide a method for determining at least one of susceptibility, resistance or tolerance to *Mycobacterium avium* subspecies *paratuberculosis* (Map) infection of a subject, comprising: obtaining a biological sample from a mammalian subject; determining, using the biological sample, a presence or absence of at least one mutation, or the genotype of at least one single nucleotide polymorphism (SNP) within at least one gene selected from the group consisting of HIVEP3 (Human immunodeficiency virus type I enhancer-binding protein 3) (SEQ ID NO:2); EDN2 (Endothelin 2) (SEQ ID NO:3); and LOC521287 (*Bos taurus* similar to forkhead box O6) (SEQ ID NO:4) that segregates with resistance and/or tolerance to Map tissue infection, or determining a presence or absence of at least one mutation or a genotype of at least one SNP within a Map infection linkage disequilibrium region (SEQ ID NO:1) that is in linkage disequilibrium with the presence or absence of the at least one mutation or with the genotype of the at least one SNP within at least one gene selected from the group consisting of HIVEP3 (Human immunodeficiency virus type I enhancer-binding protein 3) (SEQ ID NO:2); EDN2 (Endothelin 2) (SEQ ID NO:3); and LOC521287 (*Bos taurus* similar to forkhead box O6) (SEQ ID NO:4); and determining, based thereon, at least one of susceptibility, resistance or tolerance of the mammalian subject to *Mycobacterium avium* subspecies *paratuberculosis* (Map) infection.

In particular embodiments of the above methods, the at least one single nucleotide polymorphism (SNP) within Map infection linkage disequilibrium region SEQ ID NO:46, is at least one selected from the SNP group consisting of, relative to the sequence of accession no. NC_007301.3, SNPs at positions 111,606,781, 111, 610, 137, 111,611,773,111, 623, 092 and 111,682,511 (ARS-BFGL-NGS-113303) as defined herein. In certain aspects, the genotypes of at least two single nucleotide polymorphisms (SNPs) within Map infection linkage disequilibrium region SEQ ID NO:46, are determined. In particular embodiments, at least one of resistance or tolerance of the mammalian subject to *Mycobacterium avium* subspecies *paratuberculosis* (Map) infection is determined.

In certain aspects of the above methods, the mammalian subject is bovine.

Particular aspects of the above methods further comprise at least one of culling, selecting, or breeding, based on the determining of at least one of susceptibility, resistance or tolerance of the mammalian subject to *Mycobacterium avium* subspecies *paratuberculosis* (Map) infection.

Particular aspects of the above methods further comprise selective breeding to produce offspring having at least one of susceptibility, resistance or tolerance to *Mycobacterium avium* subspecies *paratuberculosis* (Map) infection.

According to particular aspects, the identification of loci associated with tolerance to Johne's disease can be used as a new prediction method to select animals to reduce spreading of *Mycobacterium avium* subspecies *paratuberculosis* in the environment and reducing the incidence and losses caused by Johne's disease.

Example 1

Loci Associated with *Mycobacterium avium* Subsp. *Paratuberculosis* (Map) Infection Status in U.S. Holstein Cattle were Identified by Whole Genome Association Analysis Overview.

The experiments and data disclosed in this working EXAMPLE 1 identify loci associated with *Mycobacterium avium* subspecies *paratuberculosis* (Map) infection status in US Holsteins. The data were obtained using the Illumina BovineSNP50 BeadChip™ whole genome SNP (single nucleotide polymorphism) assay.

The population of animals used in this study was Holstein cows from four geographically distinct herds culled for any reason, including having a Map positive diagnostic test. Specifically, two hundred forty-five cows from dairies in New York, Pa., and Vermont were followed to culling between January 1999 and November 2007 and subsequently were assessed for the presence of Map in both fecal samples and necropsy tissue. An animal was considered tissue-infected if any sample contained at least one colony-forming unit per gram of tissue (cfu/g) and the same definition was employed for fecal samples. Each animal was genotyped with the Illumina BovineSNP50 BeadChip. After quality assurance filtering, 218 animals and 45,683 SNPs remained. Genetic loci associated with the following four different case/control classifications were identified:
  presence of Map in the tissue;
  presence of Map in feces;
  presence of Map in both tissue and feces; and
  presence of Map in tissue but not feces.
A case-control genome wide association study (GWA) was conducted to test the four different classifications of Map infection status (Cases) when compared to a Map negative control group (Control). Regions on chromosomes 1, 5, 7, 8, 16, 21, and 23 were identified that showed a moderate significance ($P<5\times10^{-5}$). Regions on chromosomes 3 and 9 were identified with a high level of association to the presence of Map in tissue and both tissue and feces, respectively ($P<5\times10^{-7}$, genome-wide Bonferonni $P<0.05$).

Determination of the Presence of Map in Tissue and/or Feces.

Map infection status was evaluated from culture diagnostic testing of fecal samples and necropsy tissues. Genetic loci associated with the above four different case/control classifications were searched. The first classification tested if there were loci associated with a tissue positive result for Map, regardless of fecal status. These loci are associated with the bacterium's ability to infect the host's cells.

The second classification tested for loci associated with fecal shedding, which may be independent of those associated with Map tissue infection and may represent loci responsible for a cow's ability to transmit Map through its feces. Further, this analysis is comparable to studies that inferred disease status by the presence of fecal Map, in the absence of tissue data. When considering both fecal and tissue results to classify animals, four possible subgroups arise:

Map negative controls (fecal−, tissue−);

fecal shedding but tissue negative (fecal+, tissue−);

tissue infected but not fecal shedding (fecal−, tissue+); and

"clinical" (fecal+, tissue+).

Genome wide association case-control association tests were performed for loci associated with the following subgroups: tissue infected but not fecal shedding animals (cases) relative to negative animals (controls), and "clinical" animals (cases) relative to negative animals (controls). These two classifications were expected to identify loci associated with tissue-infected animals that were not fecal shedding as compared to "clinical" animals, and thus to allow determination of whether any loci are shared. According to particular aspects, the identification of loci associated with each of these phenotypes can be used to develop a marker-assisted selection program to aid in the control of Johne's disease. Moreover, identifying Map-tolerant or resistant genotypes represents a new way of evaluating the impact of disease on animals. Selection of animals for tolerance would put different pressures on the host (cattle) and the pathogen (Map) and may be more or less effective as a means of controlling Johne's disease than selection for disease resistance.

Materials and Methods:

Study Population and Phenotypes.

Two hundred and forty-five Holstein cows from dairies in New York (Herd A), Pennsylvania (Herds B and D), and Vermont (Herd C) were followed to culling between January 1999 and November 2007 and subsequently were assessed for the presence of Map in both fecal and necropsy tissue. Tissue samples from the ileum, ileo-cecal valve, and two adjacent ileo-cecal lymph nodes were cultured for the presence of Map following the protocols previously described in Whitlock et al. (1996, 2000). In addition, fecal samples were taken at necropsy and were cultured for the presence of Map using the same procedure. Each animal was considered tissue-infected if any cultured sample from any of the four tissues had greater than zero colony-forming units per gram of tissue (cfu/g). Fecal culture status was similarly classified. Ninety-five animals were classified as tissue positive, and 45 animals were classified as fecal positive. As expected, the sensitivity of the culture of tissue was significantly greater than the fecal culture in detecting the presence of Map. Within the tissue positive samples, fecal culture detected the presence of Map in only 40% of the samples (38 out of 94, when both tissue and fecal results were present, one tissue positive sample had a missing fecal sample). Six animals tested positive in fecal culture but not in tissue culture. The fecal cfu/g values in these animals were less than five and may represent what many consider to be fecal "pass-through", which is when an animal has a fecal positive test due to environmental conditions but is not Map infected. The distributions of the fecal and tissue results by herd are shown below in Tables 1a and 1b. Each sample was further characterized for potential confounding variables such as age at culling (median 56.5 months of age, quantiles 1 and 3 equal to 44.3 and 72.25 mo., respectively) and herd of origin.

TABLE 1a

Map tissue culture status by herd before quality control filtering of the data. Tissue positive status was determined as at least one sample from any of 4 tissues yielding at least one colony forming unit of Map (peak cfu/g > 0).

| Data Set | Negative | Positive | Unknown | Total |
|---|---|---|---|---|
| Herd A | 45 | 30 | 1 | 76 |
| Herd B | 40 | 9 | 0 | 49 |
| Herd C | 14 | 17 | 0 | 31 |
| Herd D | 38 | 39 | 12 | 89 |
| Totals | 137 | 95 | 13 | 245 |

TABLE 1b

Map fecal culture status by herd before quality control filtering of the data. Fecal positive status was determined as at least one fecal sample containing at least one colony forming unit of Map (peak cfu/g > 0).

| Data Set | Negative | Positive | Unknown | Total |
|---|---|---|---|---|
| Herd A | 71 | 4 | 1 | 76 |
| Herd B | 47 | 2 | 0 | 49 |
| Herd C | 19 | 11 | 1 | 31 |
| Herd D | 51 | 28 | 10 | 89 |
| Totals | 188 | 45 | 12 | 245 |

Genotyping.

DNA was extracted from the tissue of each animal using the Puregene DNA extraction kit per manufacturer's instructions (Gentra, Minneapolis, Minn.). Sample DNA was quantified and genotyped using the Illumina BovineSNP50 BeadChip™ (Matukumalli et al. 2008). The Illumina BovineSNP50 BeadChip™ assay contains 53,243 SNPs with a mean spacing of one SNP every 49.4 kb (median spacing of 37 kb; quartiles 1 and 3 equal to 27.6 kb and 54 kb, respectively; and a maximum distance of 1.45 Mb). The BovineSNP50 BeadChip™ also contains an additional 1,828 SNPs, which are located on contigs that are not mapped to a chromosome (Chr. Un). All samples were brought into a single BeadStudio™ file, and genotypes were identified using a custom genotype clustering file developed at the University of Missouri using more than 7,000 samples from multiple Bos taurus cattle breeds.

Quality Assurance.

Figure 16:
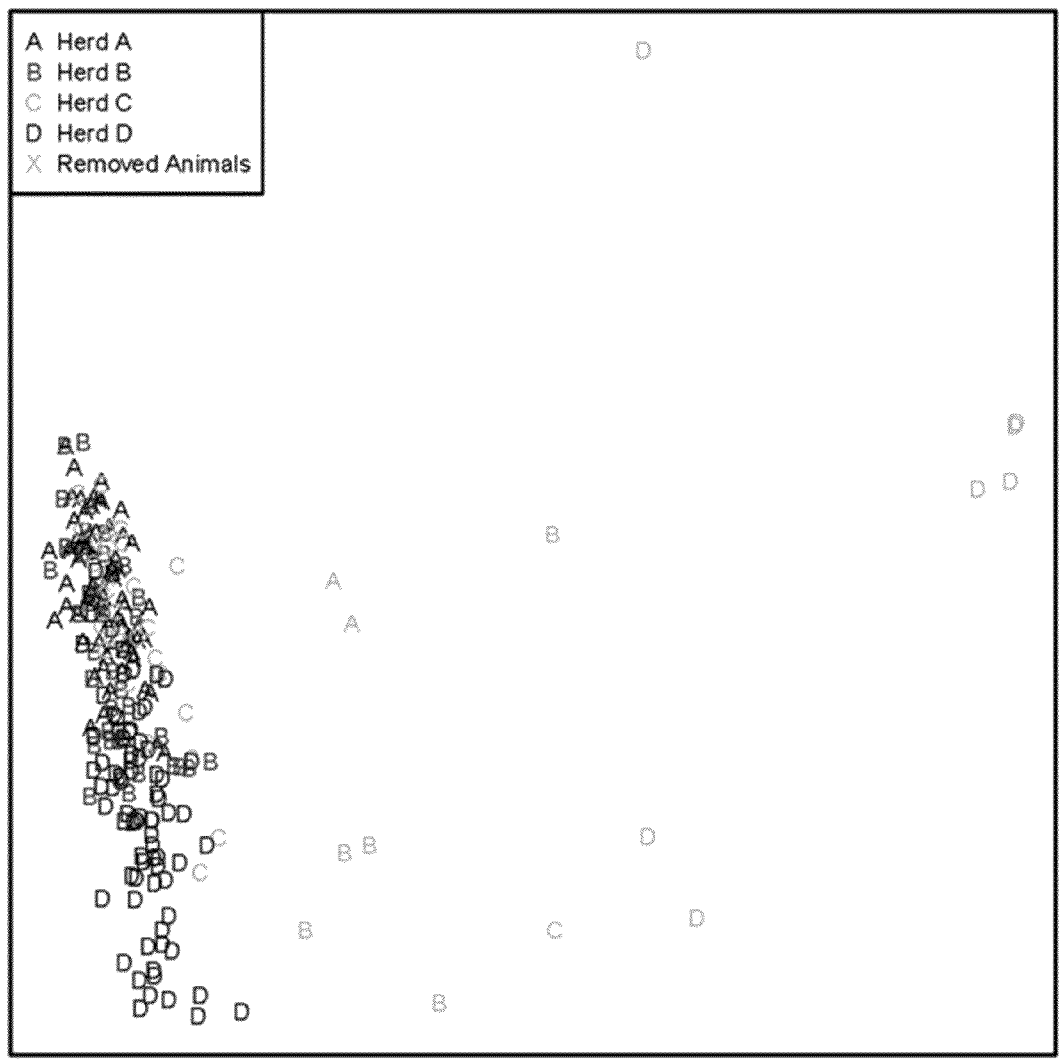
FIG. 16 shows a multidimensional scaling (MDS) plot. MDS plots provide spatial representations of data that can facilitate interpretation and reveal structural relationships in the data. This MDS plot identified 15 animals (grey) whose multilocus genotypes differed significantly from the other animals allowing these animals to be removed from further analysis.

Seven animals (one from Herd A, five from Herd B and one from Herd D) were excluded from the analysis for quality with a genotype no-call rate greater than 10%. An excess no-call rate is an indicator of low quality DNA. To assess technical variation, one animal was hybridized to two arrays, resulting in a greater than 99% identity of called genotypes (2 mismatches). Multi-dimensional scaling (MDS) of the matrix of genome-wide identity-by-state (IBS) distances was used to provide a two-dimensional projection of the data onto axes representing components of genetic variation. Animals whose genetic ancestry differs significantly appear as outliers on the MDS plot. To avoid confounding the multi-dimensional scaling by extended linkage disequilibrium, we thinned the genotype data to a set of 10,098 SNPs, in which no pair of SNPs was correlated with $r^2 > 0.2$. For this set of SNPs, the genome-wide IBS pair-wise identities between each pair of animals was computed using PLINK (Purcell et al. 2007; Version 1.04). These IBS-relationships were converted to genetic distances by subtracting them from one, and the matrix of pair-wise IBS distances was used as input for multi-dimensional scaling. The projection of the data onto the first two multi-dimensional scaling axes is shown in (FIG. 16). The multidimensional scaling (MDS) plot provides a spatial representation of data to facilitate interpretation and reveal structural relationships in the data. The MDS analysis identified fifteen animals that were clearly distinct from the majority of animals, two animals from Herd A, five animals from Herd B, one from Herd C and seven animals from Herd D. These animals were removed from further analysis, resulting in a substantial reduction of the genomic inflation factor (based on median chi-squared, data not shown).

Figure 20:
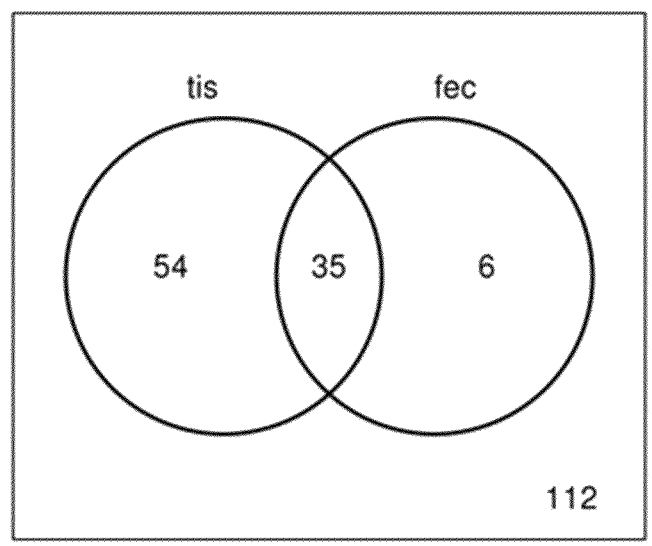
FIG. 20 shows that thirty-five animals tested positive in both fecal and tissue samples ("clinical"), 6 animals tested positive in fecal culture but not tissue ("pass-through"), 54 animals tested positive in at least one tissue sample but not fecal sample ("infected"), 112 samples tested negative for Map in both fecal and tissue samples ("negative"), 11 samples were untested for either fecal or tissue, and seven of these animals were untested for both fecal and tissue samples.

After removing animals for genotype quality and excessive genomic variance, the age ranges of the remaining control animals (tissue negative) were compared to those for tissue Map positive animals. The mean age of control animals was 58.1 months, while the mean age of the tissue Map positive animals was 60.5 months of age. Five control animals were significantly younger (approximately 12 months of age when culled) than the youngest of the tissue Map positive animals (approximately 23 months of age when culled). These animals were excluded from the study as their youth may have affected the ability to detect Map in their tissues and/or feces. The resulting mean age at culling for control animals (tissue negative) was 60 months, with a range of 21.8 to 144 months and the mean age at culling was 60.5 months for Map tissue positive animals with a range of 22.9 to 135 months. After removing 27 samples for quality, genetic variability and age, 218 animals remained in the study with an average genotype call rate of 98.9%, of which 90 animals tested positive for Map in at least one tissue sample (tissue positive) and 41 animals tested positive for Map in fecal samples (fecal positive). Thirty-five animals tested positive in both fecal and tissue samples ("clinical"), 6 animals tested positive in fecal culture but not tissue ("pass-through"), 54 animals tested positive in at least one tissue sample but not fecal sample ("infected"), 112 samples tested negative for Map in both fecal and tissue samples ("negative"), 11 samples were untested for either fecal or tissue, and seven of these animals were untested for both fecal and tissue samples (FIG. 20). These animals were left in the study to contribute to SNP level quality assurance but did not contribute to any association test statistic. The distribution of animal numbers by herd is presented in Tables 2a and 2b. 1,276 SNPs with >10% genotype no-call rate and 8,317 with a minor allele frequency (MAF) <0.01, of which 6,356 were monomorphic, were excluded. Genome-wide, 45,683 SNPs (82.9%) passed these quality control filters.

TABLE 2a

Map culture of tissue status by herd after quality control filtering of the data. Tissue positive status was determined as at least one sample in any of 4 tissues containing at least one colony forming unit of Map (peak cfu/g > 0).

| Data Set | Negative | Positive | Unknown | Total |
|---|---|---|---|---|
| Herd A | 43 | 29 | 1 | 73 |
| Herd B | 31 | 8 | 0 | 39 |
| Herd C | 13 | 17 | 0 | 30 |
| Herd D | 32 | 36 | 8 | 76 |
| Totals | 119 | 90 | 9 | 218 |

TABLE 2b

Map fecal culture status by herd after quality control filtering of the data. Fecal positive status was determined as at least one fecal sample containing at least one colony forming unit of Map (peak cfu/g > 0).

| Data Set | Negative | Positive | Unknown | Total |
|---|---|---|---|---|
| Herd A | 68 | 4 | 1 | 73 |
| Herd B | 37 | 2 | 0 | 39 |
| Herd C | 18 | 11 | 1 | 30 |
| Herd D | 45 | 24 | 7 | 76 |
| Totals | 168 | 41 | 9 | 218 |

Statistical Analysis.

Standard one-degree-of-freedom (df) allelic, 1-df dominance, 1-df recessive and 2-df (genotypic) tests of association with genotype between cases and controls were calculated. When evidence for stratification occurred, a within-herd Cochran-Mantel-Haenszel (CMH) test 2×2×K (K=4 herds) of association with genotype was performed. All calculations and plots were performed using the R statistical environment and PLINK (Purcell et al. 2007; Version 1.04). For genome-wide association, uncorrected P values less than $5 \times 10^{-7}$ provided strong evidence of association and uncorrected P values between $5 \times 10^{-5}$ and $5 \times 10^{-7}$ were considered to provide moderate evidence (Wellcome Trust Case Control Consortium 2007). Physical positions and alleles were expressed in terms of the forward strand of the reference genome (Baylor College of Medicine Human Genome Sequencing Center Btau 4.0).

Quantile-Quantile Plots.

A quantile-quantile plot (Q-Q plot) is a useful graphical method for visualizing the differences between a random sample from a population and the expected probability distribution under the null hypothesis. In a genome-wide association study, deviation of the sample distribution p-values from the expected null hypothesis distribution p-values can be attributed to extra variance in the test statistics due to population substructure (Devlin & Roeder 1999). In this study, each Q-Q plot compares the chi-squared (or Cochran-Mantel-Haenszel; CMH) p-values for each SNP versus the expected p-value distribution under the null hypothesis of no association at any locus. Each Q-Q plot was then inspected for a significant deviation from the null distribution. In addition, the median of the chi-squared values was calculated and tested for a statistical difference from the expected value under $H_o$. When the Q-Q plot and median chi-square showed evidence of population stratification, stratified analysis was performed, clustering the data within herds and performing a 2×2×4 CMH test. The resulting Q-Q plot and median chi-square was investigated after the stratified analysis to determine if clustering by herd was successful in adjusting for population stratification.

Results:

A case-control genome wide association study (GWA) was conducted to test four different classifications of Map infection status defined by results from Map culture from both tissue and fecal samples.

Association of Loci with Map Infected Tissue (Tissue Positive Vs. Tissue Negative).

Figure 1:
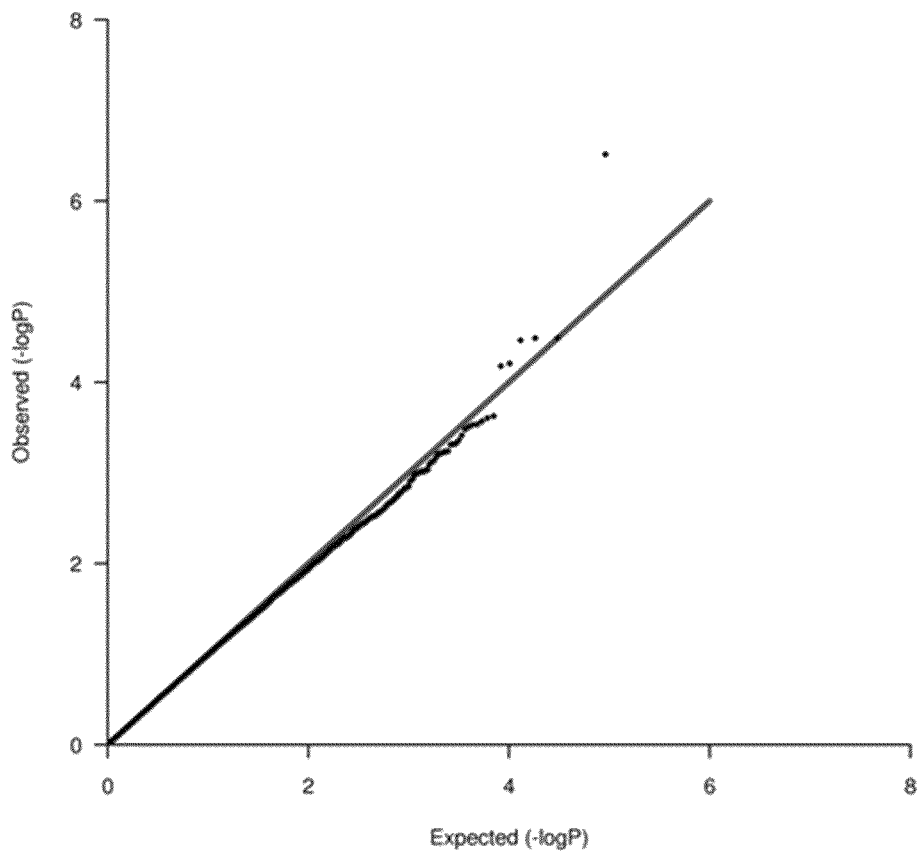
FIG. 1 shows a Q-Q plot for p-values from a 1-df test for association (allelic) versus expected for an association of loci with Map infected tissue (tissue positive versus tissue negative). The Q-Q plot shows little to no evidence of a deviation from the expected null distribution of p-values and therefore no evidence of population substructure.

Single SNP analysis was conducted to test the association of loci with a culture of tissue Map positive result. Cases in this analysis were defined as animals with a Map positive tissue result (n=90) and controls were animals with a Map negative tissue result (n=119) regardless of fecal shedding status. A strong association was found with the ARS-BFGL-NGS-113303 SNP located on BTA 3 using the basic allelic model at position 111,682,510 bp ($p=3\times10^{-7}$; P=0.014 after Bonferonni correction). Seven SNPs were found to be moderately significant ($p<5\times10^{-5}$) with Map infected tissue, located on chromosomes 1 and 21 for the basic allele frequency difference model and on chromosomes 5 and 16 using the dominance model (Dom; Table 3A). There was no evidence for population substructure on the Q-Q-plot (FIG. 1), or based on the genomic inflation factor (based on median chi-square value, $\lambda_{gc}=1$).

Table 3B shows SNPs associated with Map infection status.

TABLE 3A

Genomic regions associated with Map
(*Bonferonni significance, when applicable, in brackets).

| SNP | Chr | Pos (bp) | Pheno-type | Test | Odds Ratio | p-value | RefSeq Genes (1 Mb) |
|---|---|---|---|---|---|---|---|
| Hapmap57114-rs29012843 | 1 | 3,083,368 | Tissue | Allelic | 2.31 | 3.264e-05 | SOD1 |
| ARS-USMARC-Parent-DQ381153-rs29012842 | 1 | 3,083,498 | Tissue | Allelic | 2.31 | 3.264e-05 | SOD1 |
| BTB-00757888 | 1 | 14,995,903 | Infected | Allelic | 0.31 | 4.269e-05 | NONE |
| ARS-BFGL-NGS-113303 | 3 | 111,682,510 | Tissue | Allelic | 0.33 | 3.062e-07 *(0.014) | FOXJ3, EDN2, CTPS, CITED4, NFYC |
|  |  |  | Infected | Allelic | 0.33 | 3.290e-05 |  |
| Hapmap27802-BTA-49707 | 5 | 73,634,207 | Tissue | Dom | 0.30 | 3.708e-05 | TRA1, ALDH1L2 |
| BTA-95292-no-rs | 5 | 106,209,963 | Fecal | CMH | 91.2 | 4.163e-05 | T2R67, MAGOHB, KLRA1, KLRJ1 |
| ARS-BFGL-NGS-37513 | 7 | 47,688,319 | Clinical | CMH | 3.689 | 3.723e-05 | IGH3 |
| ARS-BFGL-NGS-3865 | 8 | 74,335,842 | Fecal | CMH | 0.30 | 3.389e-05 | STC1 |
| BTB-00478134 | 9 | 647,609 | Clinical | CMH | 41.50 | 2.511e-05 | None |
| BTB-00478151 | 9 | 698,262 | Clinical | CMH | 41.50 | 2.511e-05 | None |
| Hapmap28625-BTA-149369 | 9 | 786,610 | Clinical | CMH | 41.50 | 2.511e-05 | None |
| BTB-01957421 | 9 | 813,310 | Clinical | CMH | NA | 1.029e-07 *(0.005) | None |
|  |  |  | Fecal | CMH | NA | 1.661e-05 |  |
| BTB-01274618 | 16 | 27,186,964 | Tissue | Dom | 3.71 | 4.632e-05 | PARP-1, RPAC2, PS-2, CABC1, SCCPDH, DMNT2 |
| BTB-01274755 | 16 | 27,237,455 | Tissue | Dom | 3.97 | 2.579e-05 | PARP-1, RPAC2, PS-2, CABC1, SCCPDH, DMNT2 |
| Hapmap60593-rs29025761 | 21 | 26,660,590 | Infected | Allelic | 5.29 | 8.115e-06 | BCL2A1, ZFAND6, MESDC-2, IL16, MCEE |
| Hapmap53770-ss46526325 | 23 | 48,404,721 | Tissue | Allelic | 4.18 | 3.453e-05 | EEF1E1 |
|  |  |  | Fecal | CMH | 3.0730 | 4.392e-05 |  |

TABLE 3B

SNPs associated with Map infection status

| Phenotype | p-value | RefSeq Genes Within 1 Mb | btau40_contig | btau40_pos | Nucleotide Sequence |
|---|---|---|---|---|---|
| Infection | 3.06E-007 | FOXJ3, EDN2, CTPS, CITED4, NFYC | 3 | 111682510 | TAAAAAGACAAGAGAC ATCCAGTAGAGGCAACA GGGTGCCCAGGCCTGGG CCTCAGGAGA[A/C]AAG TTTGGGCTGGAGGTGGA CTCTAGCAATCATTGGC TAGAGATGGAAATTCAG CCTATA (SEQ ID NO: 11) |

TABLE 3B-continued

SNPs associated with Map infection status

| Phenotype | p-value | RefSeq Genes Within 1 Mb | btau40_contig | btau40_pos | Nucleotide Sequence |
|---|---|---|---|---|---|
| Infection | 8.12E-006 | BCL2A1, ZFAND6, MESDC-2, IL16, MCEE | 21 | 26660590 | CCTGTAGGATGCACACT GAACTGAGCTGTGGATG AAGCCCAGAGAAGGTG AATAATTGAC[T/G]CAA GGTCACAGGCTTGACAG GGTGACACTGAAGTACA AACTTTCTTGTCCGGCTC TGCTC (SEQ ID NO: 12) |
| Disease | 1.03E-007 | None | 9 | 813310 | AGGGGAGAAGACAGAC AGAGGATACCCAGCAAT GCCAGCTGGGAGGCTGG CTCCACCACC[C/G]GGG GCTGCTGTTGTCTCTGAT CCAGCTTTTCTAGTCTG GTGGGATGGGGTAACAT CTGTG (SEQ ID NO: 13) |
| Disease | 2.51E-005 | None | 9 | 647609 | CTAATCTCTTATTAATG GTAGCTATAATACTTTT ATATTTAGGACTTTCAG AAAAACCTG[A/G]TCAA AGTCAACAATTTCAGCA TTATCTTGGGGAAACTG TGTGTGAATGAGCTCCA CTGCC (SEQ ID NO: 14) |
| Disease | 2.51E-005 | None | 9 | 698262 | GGGGATTTTTCAGTAAG AGGTTAATAACCAGTGA GGTAAACATGTATAACA ACCTGCTTA[T/C]ATGCA CACTGGGAAGTGTCATG AACCTTTCTCACCTCCAT GCTGAGTTTCCAGAGAA CCA (SEQ ID NO: 15) |
| Disease | 2.51E-005 | None | 9 | 786610 | ATACTGTCAGAGCAGGC ATCTCAGAATCAGACAC TTTACCTGATCCCTCTCT TACAGAGT[C/G]TGAAA CAGCTTTCAAGTATTGG GAAGAGGTAGATGCTCC CCATACCAAAAGCATCC CTGC (SEQ ID NO: 16) |
| Infection | 2.58E-005 | PARP-1, RPAC2, PS-2, CABC1, SCCPDH, DMNT2 | 16 | 27237455 | AAAAAGTAGAGTGATG ACAGACCCATTATATAA TTGAAACATGTTATAAA GCCTCAACAA[A/G]TAA CACATGAATAAGAAGTC CAGAAATGGGGTCAGTT ACATAAAGGAATTTAAA ATTTAC (SEQ ID NO: 17) |
| Infectoin | 4.63E-005 | PARP-1, RPAC2, PS-2, CABC1, SCCPDH, DMNT2 | 16 | 27186964 | GATGAGATGCATCGAAA ACTGCAATGCCGGCAGC TAGCACTGGTCAACAGA AAGGGCCCA[A/G]TTCTC CATGCTAATGCCCGATT GCACAATCAATGCTTCC CAAGTTGAAGGAATTAG GCTA (SEQ ID NO: 18) |
| Infection | 3.26E-005 | SOD1 | 1 | 3083368 | ATCTGCTTGGATCTTCTC ATTAGCGAATTCCAAGA AGATGAGCCAGATCAGC CCAGGGAC[T/C]GTGAA |

TABLE 3B-continued

SNPs associated with Map infection status

| Phenotype | p-value | RefSeq Genes Within 1 Mb | btau40_contig | btau40_pos | Nucleotide Sequence |
|---|---|---|---|---|---|
| | | | | | GATCCCAGAGGAGGAC ACACACTCCCATCCTGT GAGCATTTTTCTTATGTG TCAA (SEQ ID NO: 19) |
| Infection | 3.26E-005 | SOD1 | 1 | 3083498 | tctgagtgttcattgctgcaccgcctctc caagctcccaagggcatctctctacgta ata[T/G]taatgcctggccaggtccc atccattctgacagacaaaggacaRR cgctactttacattt (SEQ ID NO: 20) |
| Disease | 3.39E-005 | STC1 | 8 | 74335842 | ACCTGATGACTATTAAG AAATTAACACGTAATCT ACATGACTGGCCAGCAG CCCCACTCA[A/G]GGAG TTCCTTACTCCTAAGCA GTTCTTAGGAGTTAGAA CTCTTCAGTTCAGTTCA GTTGC (SEQ ID NO: 21) |
| Infection | 3.71E-005 | TRA1, ALDH1L2 | 5 | 73634207 | AATAACTTAAAAATTAT TGAAGTGTAGTTTATGT ACAATGTAATGTTAATT TCATATGTA[T/C]GGCAA AACCACTCAGTTATACA GATATGTATACATGTAT ACTAGAAAAGAACCATT CTTA (SEQ ID NO: 22) |
| Disease | 3.72E-005 | IGH3 | 7 | 47688319 | ATTCTCTCTGGTCATGG CTATTCATTCGTCCCTTC CTACCTACACTTGCCCT GTTCCAGG[T/C]TGGCCA TCCTTCTCTCCATCTGCC CATTTCCTCTGGAAAAG CAACCACCTTGCAGAGA AG (SEQ ID NO: 23) |
| Disease | 4.16E-005 | T2R67, MAGOHB, KLRA1, KLRJ1 | 5 | 106209963 | ACACTTTCCAGTTTTAG ATATGCTCATATAGCAA TGCTTCCATATCTAAGC TTTAGTCTC[T/C]TGAAG GGTTTGTTGTTGTTGTTC AATCACCTAGTCATGTC CAACTCTGCAATCCCAT GGA (SEQ ID NO: 24) |
| Infection | 4.27E-005 | NONE | 1 | 17106221 | ATGTCTTGAGTAATACT TTTACTTGTTCAGAAAG TTTATTTGTTTATTTTCC ATAATGTA[T/C]GTACTG CCAGAATGTTACTCAGT ATACTCTTGTATCTATCA AACTTTCAGCAGTTAGG TC (SEQ ID NO: 25) |
| Disease | 4.39E-005 | EEF1E1 | 23 | 48404721 | GGCCCACGAGTCCTAGC CAGGTGGCCTTGCCTTG TGGCCCTGTTGAGTTGC TTTGATCAC[A/G]TGACT TGTTCATACGTGGCTGG TCCATAGGTTGGAGCAG ATTTCACACACAAACCC CTGA (SEQ ID NO: 26) |
| Qualitative (Average)/ | 1.83E-007 | PTS, IL18, TEX12, | 15 | 21254062 | AGGGAGGGTTTGGCACT GGCAAGGGGTCCATGGA |

TABLE 3B-continued

SNPs associated with Map infection status

| Phenotype | p-value | RefSeq Genes Within 1 Mb | btau40 _contig | btau40 _pos | Nucleotide Sequence |
|---|---|---|---|---|---|
| Qualitative (Peak) | | BCO2, PIH1D2, TIMM8B, CRYAB, HSPB2, NCAM1, DR2 | | | ACATGGACAGAATGAAGCTCTGGGAG[T/G]GAGGGGCAGAAGCACATGAGGAGGTCAAGCTTCAGGCCCTTCACCTTGACACAATGGGAA (SEQ ID NO: 27) |
| Quantitative | 4.23E-007 | SLC35F5, ACTR3, LYPD1 | 2 | 68641435 | CAAAGATTTTTGGTCTGATATAAATGTGTGTCTTCTTTTTAGGCCTGTGATTTTTCAATG[T/C]AAAACAAAATTTAAAACTTCTTATAATAGTATTTAGCAGGAGAAAAGAAGGAGGGAACTA (SEQ ID NO: 28) |
| Quantitative | 1.13E-005 | SLC35F5, ACTR3, LYPD1 | 2 | 68429675 | ATGTTTTGCCCTTTGATATTCACAAGGCTTCCCCATCCTATCTTTCTGGCCTCTGATACC[T/G]TCTTACCACCACCCTCCCTTTATTCTCTGTCCCTACTCAGCTTTATTTTTTTCCACAGGG (SEQ ID NO: 29) |
| Quantitative | 1.13E-005 | SLC35F5, ACTR3, LYPD1 | 2 | 68492186 | AAATGGCATGCTTCATGAAGACTCGGTGCACGGACCTGATGGAATGCTGTGCCACCTCCA[T/C]TCTTAGGCCTCGCCAAGAGGCCCCCAGTTTCTAGTAGGAAACAGGTATTAATAATGCGAG (SEQ ID NO: 30) |
| Quantitative | 1.13E-005 | SLC35F5, ACTR3, LYPD1 | 2 | 68515035 | ACCAGATATTTGGTAATTTGTTGAATGAATTAAATGCAAATGGTTTTGAAAAAATAAAAG[A/G]TATTATTGTTATCATTGTCTGTTGTACCTGTTTTCTTCCTTTAAAAGTCTTGGAAAATTC (SEQ ID NO: 31) |
| Quantitative | 2.15E-006 | TPP2, ERCC5, KDELC1, ZWINT | 12 | 76113728 | CATCCCATGGAATAAAAAAGAATACAGCTTTACACAAAACTGGTTAATGATAACTTGCAT[A/G]TGAGCTCAGTCACTTCAGTCGTGTCCGATTCTGCGCAACCCCATGGACTGTAGCCTGCCA (SEQ ID NO: 32) |
| Quantitative | 4.68E-006 | TPP2, ERCC5, KDELC1, ZWINT | 12 | 76198676 | AACAAATGAATTAAGAGATATTTGGTTGCCATGAATGTTATGTGGAAACAAGACAACTGG[T/C]GTGATAAGGAATCTGGGAAATCTGCTTACTTTTGGTACCGAAAGCTGAGCTGACTTAACC (SEQ ID NO: 33) |
| Quantitative | 1.21E-005 | ZWINT | 26 | 2605707 | AAGATTATACTAATTTTTGTAAAAAGGAGATTATAGTATGATTAAACATTAACATTCAAA[T/C]GCTGATTTAAATTGTGCATATA |

TABLE 3B-continued

SNPs associated with Map infection status

| Phenotype | p-value | RefSeq Genes Within 1 Mb | btau40_contig | btau40_pos | Nucleotide Sequence |
|---|---|---|---|---|---|
| | | | | | TTTTTCTCATTTCTTATT GAATTTATGATCATTGA TGA (SEQ ID NO: 34) |
| Qualitative (Average) | 2.68E-005 | PPID, ETFDH, TMEM144 | 17 | 42419533 | CGCCCTTTTCCTGTAAC AAGAGGCTAGAATTTTC CACTTTTATTGCCTTGGA GAAGAAAC[A/G]AAGCA GATGTCTGCAGGAAACA AAGGAATCAAATTTGTA GTATTTAATTGCCAAAG GCCC (SEQ ID NO: 35) |
| Quantitative | 3.11E-005 | CDKN2B, IFNT | 8 | 22806810 | TCAGGGTAGGAAAGCTT TATGGTATAATTCATGC TCCAAAAGCTCCCCATA GGATCAGGT[T/G]AACC CACATCTTGGCCTGTCC TGTTGTGCCTCCCTTGTT CCATTTCAGGTTTCTCCT GAA (SEQ ID NO: 36) |
| Qualitative (Peak) | 3.80E-005 | NONE | 6 | 51851114 | AAGATCTTGGCATGCTT TCAATTCCTCAAGGAGA TAAGGAAAGAAAAATA AACAGCACTA[T/C]AGA AAAATATGAATTAGTCC TGGAAATGGCAGGTATC TCTAGGCCTTACATCAC ATTAGC (SEQ ID NO: 37) |
| Qualitative (Average) | 3.85E-005 | UBXN4, MCM6, DARS, CXCR4 | 2 | 64266248 | ACTACTTCAGCCTTACT CTTTTAGAATTGTAGTC AGAAAAGATTGTGAGTC GTTTGGAAA[T/C]GAGC ACTTAGCCCATTTCTATC GCACGCTGGAAACTATG AACATTTTCACTGCACG TACA (SEQ ID NO: 38) |
| Qualitative (Peak) | 3.87E-005 | NONE | 6 | 51772055 | CTGCTTGGAAAATTCAT ACCAAAAGCAGTAACA GGAAATGTGCAGAGGGT TTTCTGTGTG[T/C]CCAG CACAGTGTAAGTAAGCT TAATAATCCCTATTTTCT TAATTCATTCCACACAA AGGA (SEQ ID NO: 39) |
| Quantitative | 4.02E-005 | STAC, LRRFIP2, PLCD1 | 22 | 10999946 | CAAAGAGGTCTGAGTTT CTGATGGCAATTCATAA AGTGACACTGAATTCCA AGAGTAAAT[A/G]TCTG AAAAAAGCCAGAGCCA TCTAAATAGAACAGCAG AGAGAGGAGGACAGAG AAAGCAG (SEQ ID NO: 40) |
| Qualitative (Average) | 4.49E-005 | COMMD2, PFN2, RNF13, TIM4SF4, TIM4SF1, TM4SF18, GYG1, CPB1, AGTR1 | 1 | 120575773 | CAGGCCACCTGAATTGG ATCTTTGCTTCTCTACTT TTTAGTAGTAACTTTGG TAAGTTAC[A/G]TAACCT CCCAGGGCCTCAGATTT CTCACCTGTAAAGTGGG AGTAATGTGCACACCTG GTA (SEQ ID NO: 41) |

TABLE 3B-continued

SNPs associated with Map infection status

| Phenotype | p-value | RefSeq Genes Within 1 Mb | btau40 _contig | btau40 _pos | Nucleotide Sequence |
|---|---|---|---|---|---|
| Qualitative (Average) | 4.54E-005 | R3HDM2 | 16 | 8218820 | AAATGGCTTTTTTACAT GAAGCAACATGTACCAG GACCTCTATTATTCACT ACAAAGAAA[A/G]TAGT GAATAATGCTCCATGTC TCAGAATTCTTGTGTAT AAAATGAGAATTATCAA ATACT (SEQ ID NO: 42) |
| Quantitative | 4.72E-005 | ARPP-19, CYP19, SCG3, LYSMD2, TMOD3, LEO1, GNB5 | 10 | 59551460 | ATAGGGAGAGAGTTATA CTCCTGCAAAGGACTGT TTACCCCCCTTCAAAAA TGTGCATTA[A/G]TCATT AGCTAAGTGACAGTGGG TAGATGGAAAGGTGACT TTATTCAGTGATATTTTT CTA (SEQ ID NO: 43) |
| Qualitative (Peak) | 4.76E-005 | DDX10, FDX1, RDX | 15 | 18460127 | CTTATACATAAAGTTCA ATTTTTTTTATATGGTAT AAAATGCCCTTTAAGAT CTGGCTCA[A/G]TGTCTT CTTATCAACCTCATTTTT CACTTCCCATTTTTTTCA GTTCTGCACACAGTCCC A (SEQ ID NO: 44) |

Association of Loci with Map Fecal Positive (Fecal Positive Vs. Fecal Negative).

Single SNP analysis was conducted to test the association of loci with a positive Map fecal culture. Cases in this analysis were defined as animals with a positive fecal culture result (n=41) and controls were defined as animals with a negative fecal culture result (n=168), regardless of culture of tissue status. The standard allelic, dominance, recessive, and genotypic models showed evidence that the results were influenced by population substructure (identified by Q-Q-plot, FIG. 2 and genomic inflation factor, $\lambda_{gc}=1.10$). This was likely due to Herds A, B, and C containing fewer fecal positive animals relative to Herd D. To account for population substructure, a stratified analysis (CMH test) was performed within each herd. Investigation of the resulting Q-Q-plot (FIG. 3) and the genomic inflation factor ($\lambda_{gc}=1.0$) shows this test successfully accounted for population substructure. CMH test results showed no strong associations with a P value of less than $5 \times 10^{-7}$; however, four SNPs were found to be moderately significant ($p<5 \times 10^{-5}$) located on chromosomes 5, 8, 9, and 23 (Table 1 above).

Association of Loci with Map Tissue Infection but Fecal Culture Negative (Infected).

Figure 4:
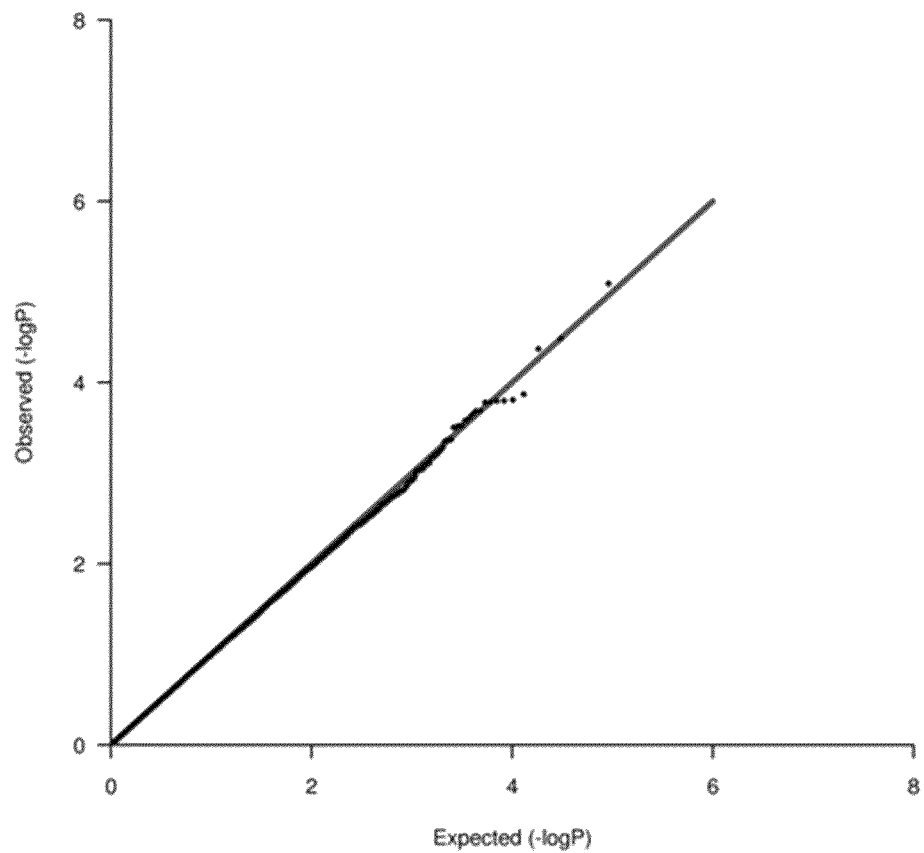
FIG. 4 shows a Q-Q plot for 1-df test for association (allelic) versus expected for an association of loci with Map tissue infected, fecal negative (infected) cases versus controls. The Q-Q plot shows little to no evidence of a deviation from the expected null distribution of p-values and therefore no evidence of population substructure.

Single SNP analysis was conducted to test the association of loci with Map tissue infection but with a negative fecal culture result. Cases in this analysis were defined as animals with a positive culture of tissue result and a negative fecal culture (n=54), and controls were defined as animals with a negative culture of tissue result and a negative fecal culture (n=112). No strong association with any SNPs was identified using the allelic, dominant, recessive, or genotypic model, but three SNPs were identified with moderate P values using the allelic model. Two SNPS located on chromosomes 3 and 21 were the same as those found associated with tissue positive status. The third SNP was a newly identified locus found on chromosome 1, 14 Mb downstream of the SNPs found with a moderate association with a tissue positive result (Table 3A). Analysis of "infected" animals did not show evidence for population substructure in the Q-Q-plot (FIG. 4) or genomic inflation factor ($\lambda_{gc}=1$).

Association of loci with the class Map tissue infected, fecal positive (clinical). Single SNP analysis was conducted to test the association of loci with a Map tissue infection and positive fecal culture ("clinical"). Cases in this analysis were defined as animals with a positive tissue and a positive fecal culture result (n=25), while controls were defined as animals with a negative tissue and a negative fecal culture result (n=112). The standard allelic, dominance, recessive, and genotypic models showed evidence that results were influenced by population substructure (identified by Q-Q-plot, FIG. 5 and genomic inflation factor, $\lambda_{gc}=1.06$). To account for population substructure a stratified analysis (CMH test) was performed within the herds. Investigation of the resulting Q-Q-plot (FIG. 6) and the genomic inflation factor (GC=1.0) shows this test successfully accounted for population substructure. One strong association was found with SNP BTB-01957421 located on BTA 9 using the CMH test stratifying within herd ($p=1 \times 10^{-7}$; P=0.004 after Bonferroni correction). Four other SNPs, 3 located on chromosome 9 adjacent to BTB-01957421, showed moderate association ($p=2.5 \times 10^{-5}$) as did one on chromosome 7 ($p=3.72 \times 10^{-5}$) (Table 3A).

REFERENCES CITED FOR THIS EXAMPLE 1, AND INCORPORATED HEREIN FOR THEIR RESPECTIVE TEACHINGS

1. USDA—Animal and Plant Health Inspection Service (APHIS) (2008), Johne's Disease in U.S. Dairies, 1991-2007. *USDA Info Sheet*, April.
2. Bentley R. W., Keenan J. I., Gearry R. B., Kennedy M. A., Barclay M. L. & Roberts R. L. (2008) Incidence of *Myco-* bacterium avium subspecies *paratuberculosis* in a population-based cohort of patients with Crohn's disease and control subjects. *American Journal of Gastroenterology* 103(5) 1168-1172.
3. Clarke C. J. (1997) The pathology and pathogenesis of *paratuberculosis* in ruminants and other species. *Journal of Comparative Pathology* 116, 217-261.
4. Collins M. T., Gardner I. A., Garry F. B., Roussel A. J. & Wells S. J. (2006) Consensus recommendations on diagnostic testing for the detection of *paratuberculosis* in cattle in the United States. *Journal of the American Veterinary Medical Association* 229, 1912-1919.
5. Gonda M. G., Chang Y. M., Shook G. E., Collins M. T. & Kirkpatrick B. W. (2006) Genetic variation of *Mycobacterium avium* ssp *paratuberculosis* infection in US Holsteins. *Journal of Dairy Science* 89, 1804-12.
6. Gonda M. G., Kirkpatrick B. W., Shook G. E. & Collins M. T. (2007 Identification of a QTL on BTA20 affecting susceptibility to *Mycobacterium avium* ssp. *paratuberculosis* infection in US Holsteins. *Animal Genetics* 38, 389-396.
7. Harris N. B. & Barletta R. G. (2001) *Mycobacterium avium* subsp. *paratuberculosis* in veterinary medicine. *Clinical Microbiology Review* 14, 489-512.
8. Hinger M., Brandt H., Horner S. & Erhardt G. (2007) Short Communication: Association Analysis of Microsatellites and *Mycobacterium avium* Subspecies *paratuberculosis* Antibody Response in German Holsteins. *Journal of Dairy Science* 90, 1957-1961.
9. Hinger M., Brandt H. & Erhardt G. (2008) Heritability estimates for antibody response to *Mycobacterium avium* subspecies *paratuberculosis* in German Holstein cattle. *Journal of Dairy Science* 91, 3237-3244.
10. Koets A. P., Adugna G., Janss L. L. G., van Weering H. J., Kalis C. H. J., Wentink G. H., Rutten V. P. M. G. & Schukken Y. H. (2000) Genetic Variation of Susceptibility to *Mycobacterium avium* subsp. *paratuberculosis* Infection in Dairy Cattle. *Journal of Dairy Science* 83, 2702-2708.
11. Matukumalli L. K., Lawley C. T., Schnabel R. D., Taylor J. F., Allan M., Heaton M. P., O'Connell J. R., Sonstegard T. S., Smith T. P. L., Moore S. S. & Van Tassell C. P. (2008) Development and characterization of a high density SNP genotyping assay for cattle. *Genome Res*. (Submitted).
12. McCartney S. A., Ballinger A. B., Vojnovic I., Farthing M. J. G. & Warner T. D. (2002) Endothelin in human inflammatory bowel disease: comparison to rat trinitrobenzene-sulphonic acid-induced colitis. *Life Sciences* 71, 1893-1904.
13. McKenna S. L. B., Keefe G. P., Barkema H. W. & Sockett D. C. (2005) Evaluation of three ELISAs for *Mycobacterium avium* subsp. *paratuberculosis* using tissue and fecal culture as comparison standards. *Veterinary Microbiology* 110, 105-111.
14. Momotani E., Whipple D. L., Thiermann A. B. & Cheville N. F. (1988) Role of M cells and macrophages in the entrance of *Mycobacterium paratuberculosis* into domes of ileal peyer's patches in calves. *Veterinary Pathology* 25, 131-137.
15. Mortensen H., Nielsen S. S. & Berg P. (2004) Genetic Variation and Heritability of the Antibody Response to *Mycobacterium avium* subspecies *paratuberculosis* in Danish Holstein Cows. *Journal of Dairy Science* 87, 2108-2113.
16. Ott S. L., Wells S. J. & Wagner B. A. (1999) Herd-level economic losses associated with Johne's disease on US dairy operations. *Preventative Veterinary Medicine* 40, 179-192.
17. Purcell S., Neale B., Todd-Brown K., Thomas L., Ferreira M. A. R., Bender D., Maller J., Sklar P., de Bakker P. I. W., Daly M. J. & Sham P. C. (2007) PLINK: a toolset for whole-genome association and population-bases linkage analysis. *American Journal of Human Genetics* 81, 559-575.
18. Reddacliff, L. A., Beh K., McGregor H. & Whittington R. J. (2005) A preliminary study of possible genetic influences on the susceptibility of sheep to Johne's disease. *Australian Veterinary Journal* 83, 435-441.
19. Takizawa S., Uchide T., Adur J., Kozakai T., Kotake-Nara E., Quan J. & Saida K. (2005) Differential expression of endothelin-2 along the mouse intestinal tract. *Journal of Molecular Endocrinology* 35, 201-209.
20. Taylor K. H., Taylor J. F., White S. N. & Womack J. E. (2006) Identification of genetic variation and putative regulatory regions in bovine CARD15. *Mammalian Genome* 17, 892-901.
21. Waters W. R., Stabel J. R., Sacco R. E., Harp J. A., Pesch B. A. & Wannemuehler M. J. (1999) Antigen-specific B-cell unresponsiveness induced by chronic *Mycobacterium avium* subsp. *paratuberculosis* infection of cattle. *Infection and Immunity* 67, 1593-1598.
22. Wellcome Trust Case Control Consortium (2007) Genome-wide association study of 14,000 cases of seven common diseases and 3,000 shared controls. *Nature* 447, 661-78.
23. Whitlock R. H., Wells S. J., Sweeney R. W. & Van Tiem J. (2000) ELISA and fecal culture for *paratuberculosis* (Johne's disease): sensitivity and specificity of each method, *Veterinary Microbiology* 77, 387-398.
24. Whitlock R. H., Rosenberger A. E., Sweeney R. W. & Spencer P. A. (1996) Distribution of *M. paratuberculosis* in tissues of cattle from herds infected with Johne's disease. In: Proceedings of the Fifth International Colloquium on *Paratuberculosis* (ed. By R. J. Chiodini, M. E. Hines & M. T. Collins), 29 Sep.-4 Oct. 1996, International Association for *Paratuberculosis*, 44 Francis Street, Rehoboth, Mass., USA, 168-174.
25. Whittington R. J. & Sergeant E. S. G. (2001) Progress towards understanding the spread, detection and control of *Mycobacterium avium* subsp. *paratuberculosis* in animal populations. *Australian Veterinary Journal* 79, 267-278.
26. Wu C.-W., Livesey M., Schmoller S. K., Manning E. J. B., Steinberg H., Davis W. C., Hamilton M. J. & Talaat A. M. (2007) Invasion and persistence of *Mycobacterium avium* subsp. *paratuberculosis* during early stages of Johne's disease in calves. *Infection and Immunity* 75, 2110-2119.
27. Devlin B. & Roeder K. (1999) Genomic control for association studies. *Biometrics* 55, 997-1004.

Example 2

Identification of Loci Associated with Tolerance to Johne's Disease in U.S. Holstein Cattle Overview.

Johne's disease is an incurable contagious bacterial illness caused by *Mycobacterium avium* subspecies *paratuberculosis* (Map). While the heritability of tolerance has been estimated at 0.09±0.036, the loci associated with tolerance have not yet been investigated. The low sensitivity of the current diagnostic techniques and the long incubation period (4 to 5 years) until the appearance of clinical signs are some of the major road blocks to controlling the disease (Chiodini & Merkal 1984; Collins et al. 2006).

The eradication of the disease has not been successfully obtained by traditional methods, and therefore new approaches are needed. One such approach is the genetic selection of animals that are tolerant to Johne's disease. Cattle have evolved defense mechanisms to fight pathogens, such as resistance and tolerance. Co-evolution between hosts and pathogens is believed to increase the biological diversity among animals and pathogens (Burdon and Muller 1987). Tolerance aims to reduce the harm caused by the parasite, whereas resistance prevents the infection of the pathogen. For the pathogen, tolerance results in a reduction of virulence, thereby increasing selection pressure for pathogens to exhibit higher growth rates. For the host, tolerance will tend to increase disease prevalence, while reducing the individual risk of death from the disease (Miller et al. 2006). Weiss and colleagues (2006) suggested that a state of tolerance may exist in the intestine of cows sub-clinically infected with *Mycobacterium avium* subsp. *paratuberculosis* after they analyzed the mucosal immune response of these cows. Zanella and colleagues (2008), found that tolerance to bovine *paratuberculosis* is heritable with estimates of 0.09±0.036. Gonda et al. (2007) were the first to report evidence of QTL (Quantitative Trait Loci) on chromosome 20 (BTA20) associated with suceptibility to Johne's disease. However the investigation or identification of the loci associated with tolerance to animal disease has not been undertaken.

The purpose of this EXAMPLE 2 was to identify loci associated with tolerance to Johne's disease in cows infected with Map using a genome-wide approach. Such identification could be used to develop a marker-assisted selection program to reduce the severity and the losses caused by Johne's disease in cattle.

Feces, ileum, two mesenteric lymph nodes, and tissue from the ileo-cecal valve were harvested and cultured for Map from 260 Holstein cows from four dairy herds. Ninety-four cows had a Map tissue colony-forming unit (CFU) value $\geq 1$; 42 of these had fecal CFU values $\geq 1$, and 8 animals had fecal CFU values exceeding their tissue CFU values. To compute a tolerance (T) index, the fecal CFU value +100 was divided by the tissue CFU value +100. Peak and average fecal and tissue values were used to determine $T_{peak}$ and $T_{average}$ for each animal. Genotyping of these 94 animals was conducted with the Illumina bovineSNP50 bead array. After quality filtering and genotype pruning, 45,591 SNPs for 89 animals remained. The results did not show evidence for population substructure (genomic inflation factor, based on median Chi-sq statistic $\lambda_{GC}=1.03$). Whole genome association analysis was conducted using the R statistical environment and PLINK. Tolerance values were treated as a quantitative trait and compared with allele frequencies for each SNP. Strong evidence for association was identified with $T_{peak}$ and a locus on BTA15 ($P=1.8\times10^{-7}$, after Bonferroni correction P=0.0079) while moderate evidence for association ($P=3.8\times10^{-5}$) was identified on two adjacent SNPs on BTA 6. The same SNP on BTA 15 showed moderate evidence for association ($P=3\times 10^{-6}$) with $T_{average}$. Four additional SNPs also showed moderate evidence for association on BTA 17 ($P=2.68\times10^{-5}$), BTA 2 ($P=3.8\times10^{-5}$), BTA 1 ($P=4.5\times10^{-5}$) and BTA 16 ($4.5\times 10^{-5}$). This is the first study to evaluate and identify genetic tolerance loci with disease in cattle.

Materials & Methods:

Selection of Animals and Data Collection.

Fecal samples for two hundred fifty-four Holstein cows from four dairy herds located in New York (Herd A), Pennsylvania (Herd B and Herd C), and Vermont (Herd D) were cultured every 3 to 6 months between January 1999 and November 2007 or until the animals were culled. The disease status of the animals was determined by the number of colony forming units of Map from culture of tissue samples of the ileum, ileo-cecal valve, and two adjacent ileo-cecal lymph nodes harvested at slaughter, as described by Whitlock et al. (1996 and 2000).

Tolerance was estimated in animals that in which the tissue was infected with Map. The disease status of the animals was determined by the results of the tissue culture, because of the higher sensitivity of tissue culture compared to fecal culture or ELISA. Animals were considered to be Johne's positive if they had one or more colony-forming units per gram of tissue (CFU$_t$/g>1) in any of the four tissues examined. Ninety-four (36%) of the animals tested had tissue infected with Map (Table 4). The mean age of animals was 59 months, with a range of 22.87 to 135 months.

TABLE 4

Distribution of infected animals by herd.

| Herd | Total |
| --- | --- |
| Herd A | 30 |
| Herd B | 9 |
| Herd C | 16 |
| Herd W | 39 |
| Total | 94 |

Figures 7A, 7B:
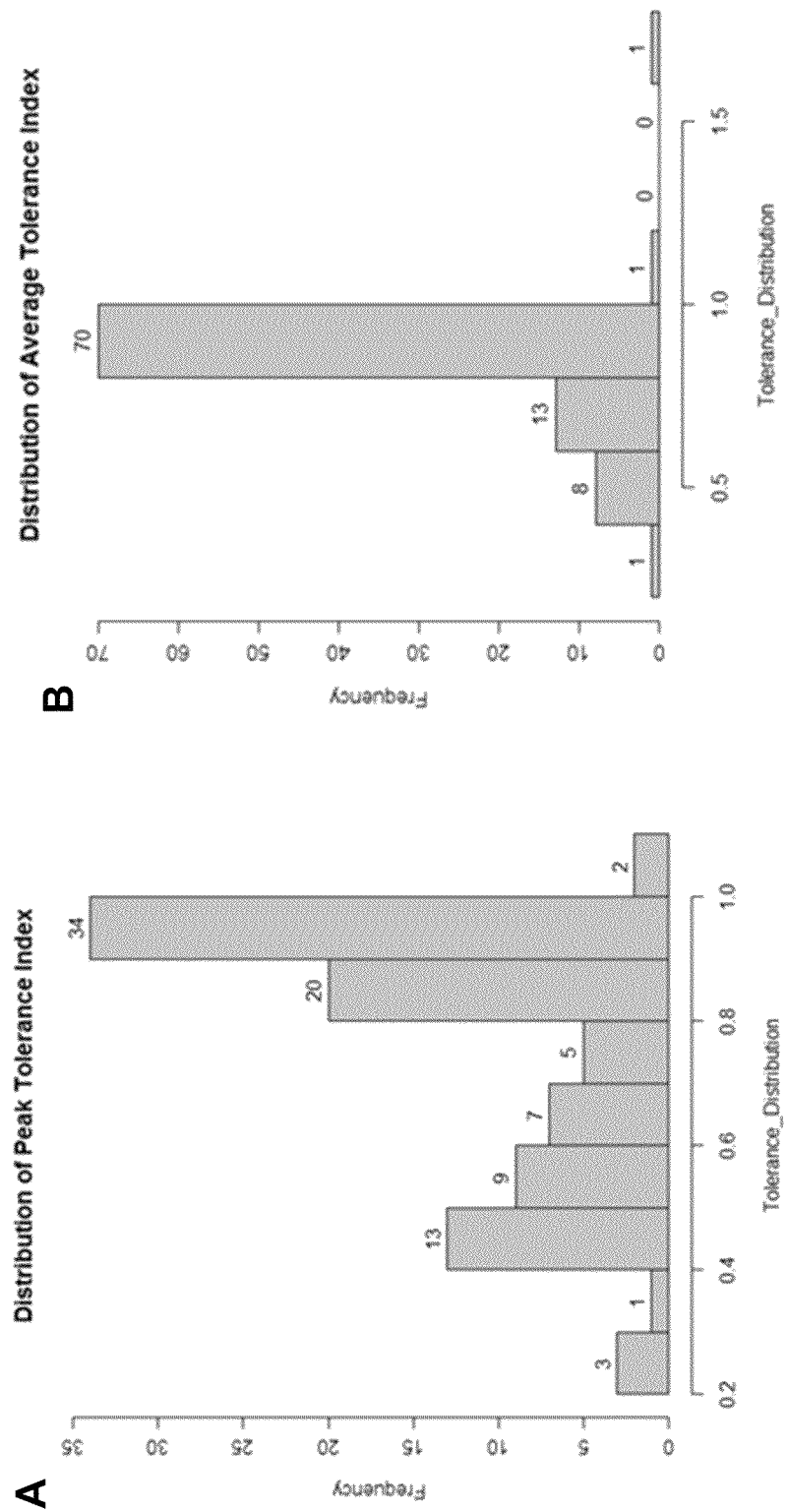
FIGS. 7A and 7B show a tolerance distribution using peak (left panel) and average (right panel) fecal CFUs and peak (left panel) and average (right panel) tissue CFUs taken at slaughter. The tolerance index was defined as the fecal CFUs $(CFU_f)+100$ divided by the tissue $(CFU_t)+100$.

The tolerance index (T) was calculated using the peak ($T_{Peak}$) 1 and average ($T_{Average}$) CFUs for feces and tissue taken at slaughter. The tolerance index was defined as the fecal CFUs (CFU$_f$)+100 divided by the tissue CFUs (CFU$_t$)+100 (FIGS. 7 A and B).

DNA Preparation and Genotyping.

DNA was extracted from 15-40 mg of tissue from each animal using the Puregene DNA extraction kit per manufacturer's instructions (Gentra, Minneapolis, Minn.). DNA samples were quantified using NanoDrop spectrophotometry, and DNA purity was estimated using the 260/280 ratio. Samples with 260/280 ratios below 1.8 and higher than 2.0 were excluded because of possible protein and (or) RNA contamination that could compromise the quality of the genotype. Five micrograms of DNA were diluted to a final concentration of 50 ng/μl and genotyped with the Illumina BovineSNP50 BeadChip as described (Matukumalli et al., 2008). The Illumina BovineSNP50 beadchip assay contains 55,074 SNPs with a mean spacing of one SNP every 35 kb across the bovine genome.

Quality Assurance.

Figure 8:
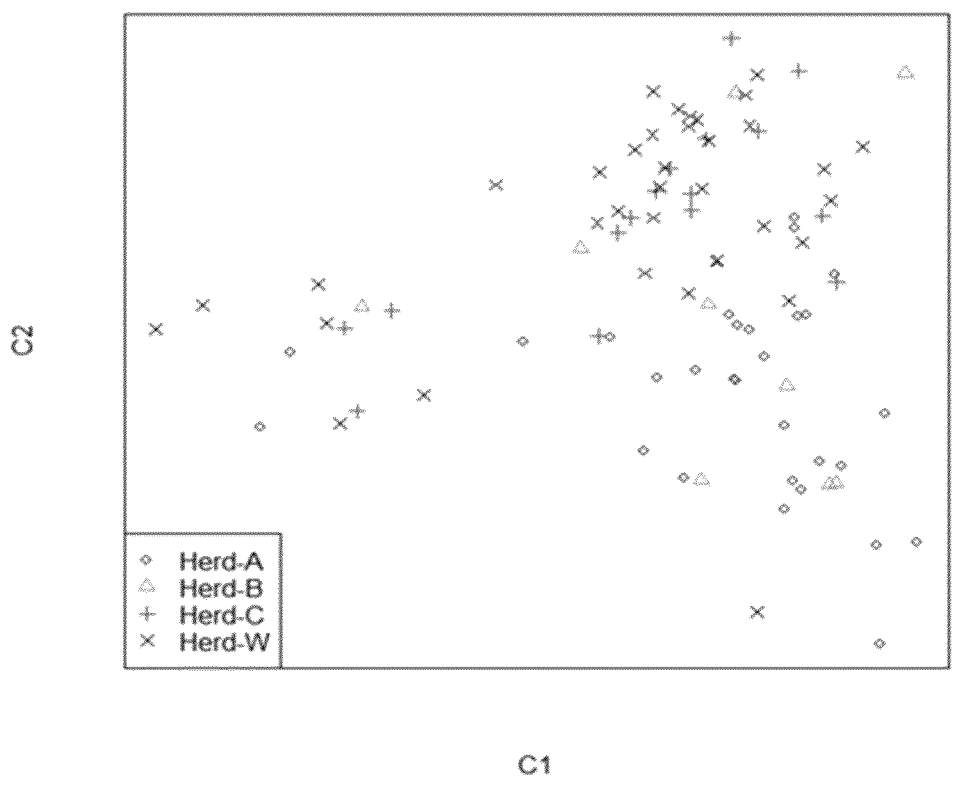
FIG. 8 shows a multidimensional scaling (MDS). MDS provides a spatial representation of the relationship between animals. MDS plots also are useful for detecting underlying substructure in the data. In this experiment, the MDS plot did not identify a population substructure.

All samples were brought into a single BeadStudio file, and genotypes were identified using a custom cluster file that was based on >2,000 samples from multiple cattle breeds. Samples were first evaluated for quality control. Two samples were removed from the analysis because of a no call rate greater than 10%. These samples were removed because samples with a call-rate less than 90% may be due to degraded DNA. Multidimensional scaling analysis (MDS) plotted the genome-wide identity-by-state (IBS) of the SNPs to identify animals with significant genetic variation. Animals (n=3) with different genetic backgrounds were removed from the analysis. After exclusion of the outlier from the analyses, MDS plot showed all the animals with similar genetic ancestry (FIG. 8). After the removal of animals for quality control, eighty-nine animals (n=89) remained for the analyses with a call rate of 98.9%. In addition to evaluation of the samples for quality, the SNPs were also scrutinized. Monomorphic SNPs (6,356), SNPs with minor allele frequencies less than 1%

(8,185), and SNPs with greater than a 10% no call-rate (1,503) were removed from the analysis. After frequency and genotyping pruning, 45,591 SNPs were left for the association analysis.

Association Analysis.

Figure 9:
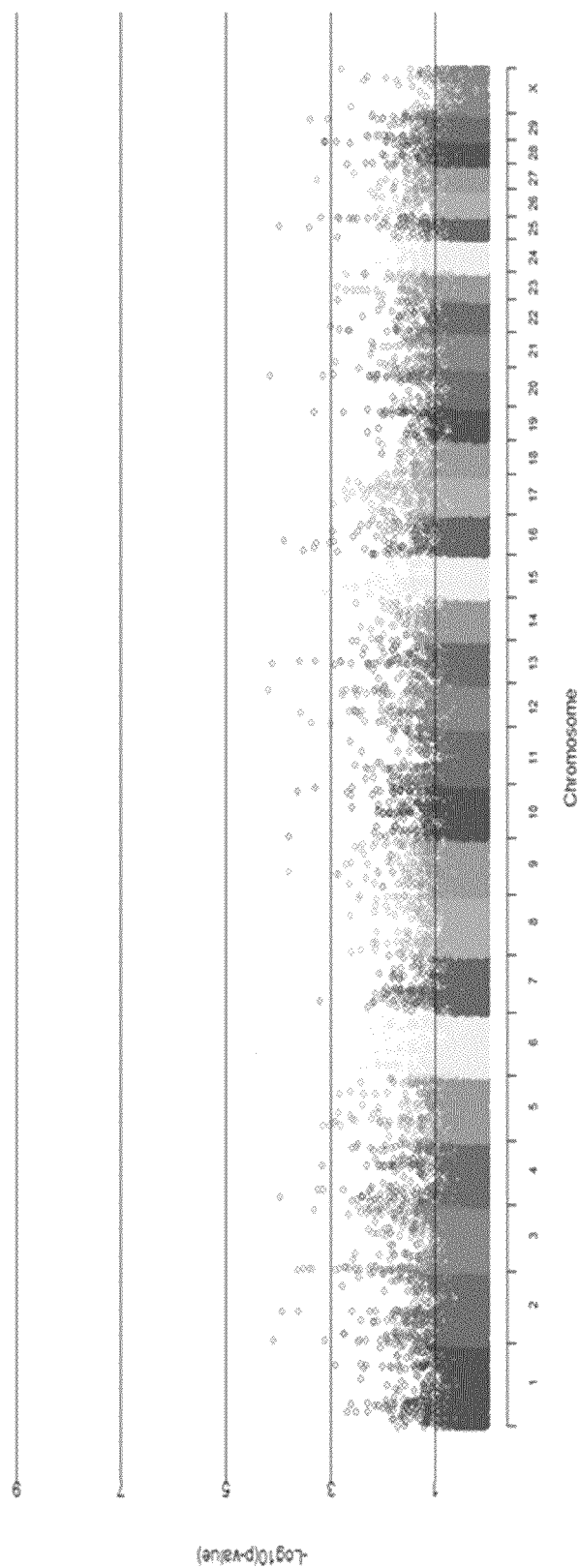
FIG. 9 shows a genome-wide plot of $-\log_{10}$ (p-values) for an association of loci with tolerance index calculated using the peak fecal divided by peak tissue. Chromosomes 1 through 29 and Chromosome X are shown.
Figure 10:
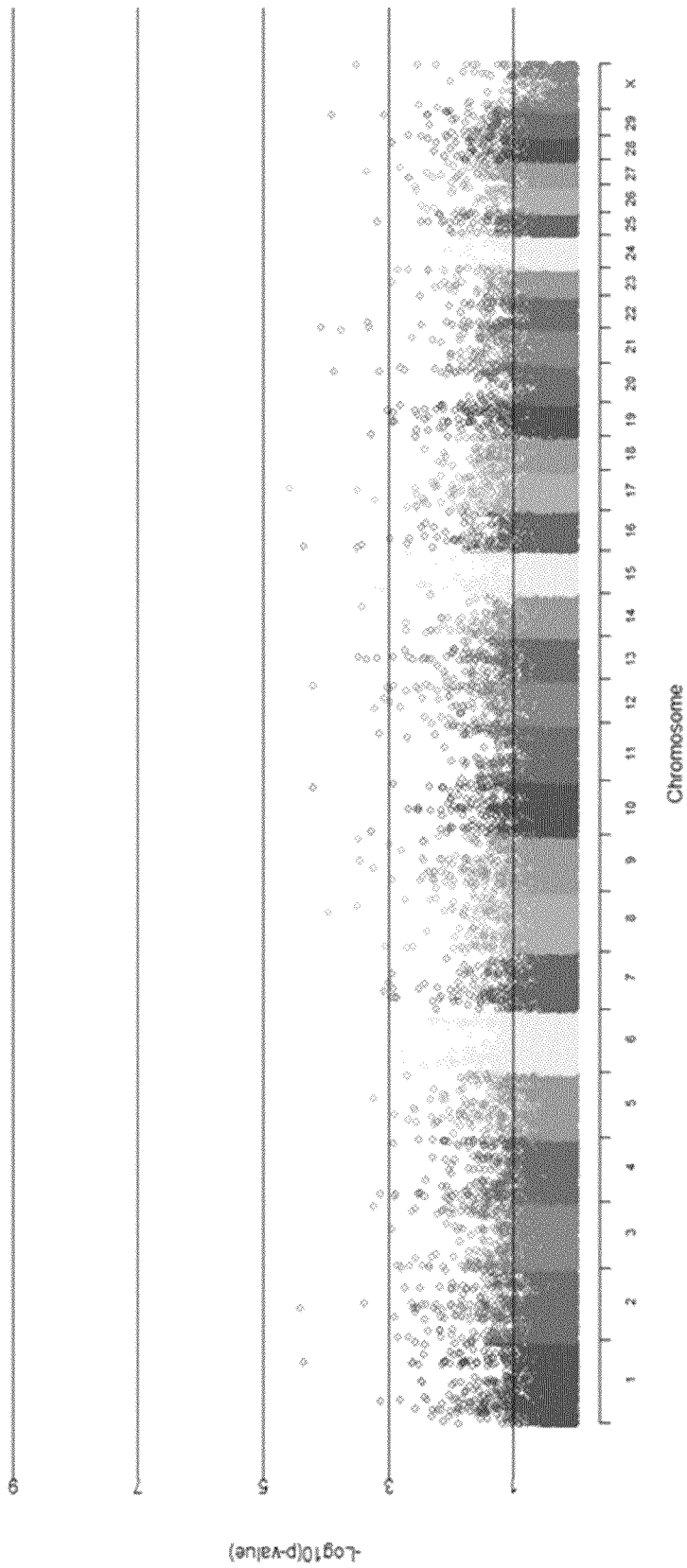
FIG. 10 shows a genome-wide plot of $-\log_{10}$ (p-values) for an association of loci with tolerance index calculated using the average fecal divided by average tissue. Chromosomes 1 through 29 and Chromosome X are shown.

The whole genome association study was conducted to find SNP's associated with the spectrum of tolerance values in animals with tissue infected with Map (FIGS. 9 and 10). For this approach tolerance was treated as a quantitative trait. $T_{Peak}$ values ranged from $T_{Peak}$=0.27 to 1.07 and $T_{Average}$ value ranged from $T_{Average}$=0.35 to 1.64. The whole genome association analysis was conducted using the R statistical environment and PLINK (Purcell et al. 2007, Version 1.04). The likelihood ratio test and the Wald statistical test were used within PLINK. Significance for association tests were based on the recommendation of the Welcome Trust Case Control Consortium (2007) where unadjusted P values less than $5 \times 10^{-7}$ were considered to provide strong evidence of association and unadjusted P values between $5 \times 10^{-5}$ and $5 \times 10^{-7}$ were considered to provide moderate evidence for association. Associations with strong evidence as defined by the Welcome Trust Case Control Consortium coincide with the associations identified after Bonferroni correction for multiple testing.

Results:

Quantitative Analysis for Association of Loci with Tolerance.

Figure 11A:
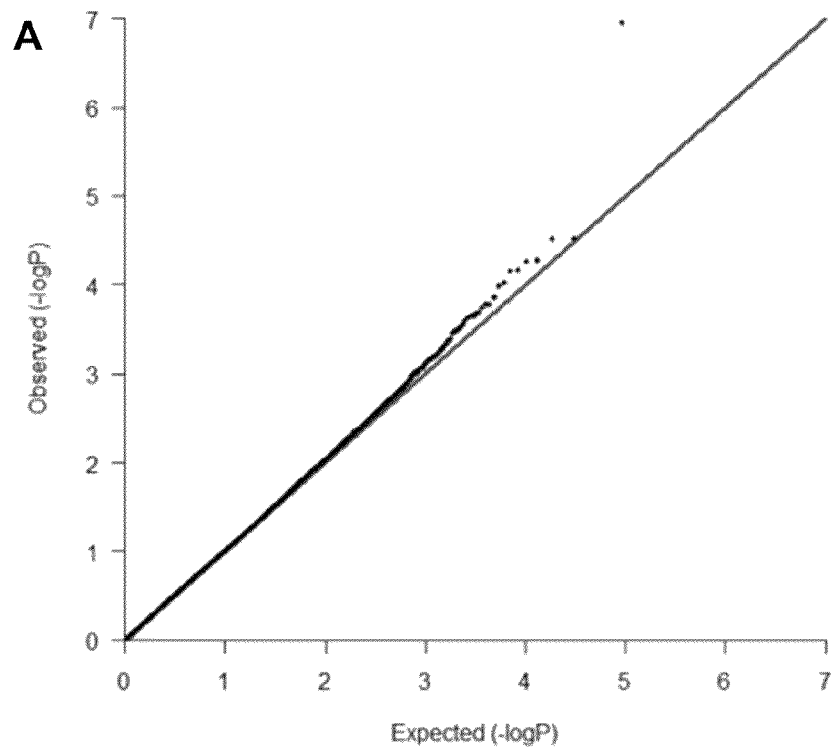
FIGS. 11A and B show a Q-Q plot of an association analysis with tolerance as a quantitative trait. In panel 5a the peak fecal CFUs is divided by the peak tissue CFUs. The results indicate that there was no evidence of population stratification ($\lambda_{GC}=1.03$). Panel 5b shows the results of an average fecal CFUs divided by average tissue CFUs showing no evidence of population stratification ($\lambda_{GC}=1.00$).
Figure 11B:
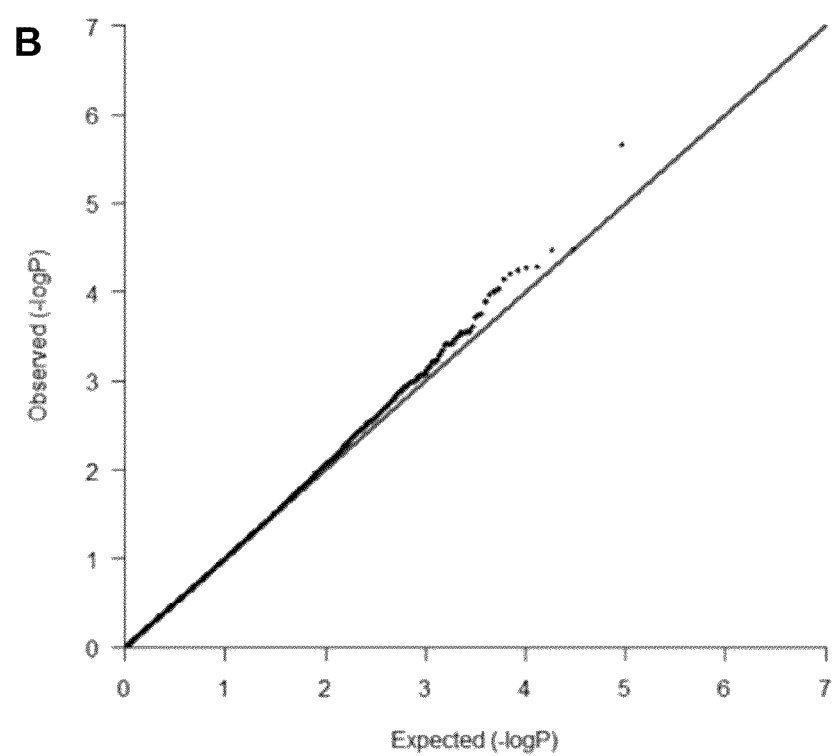

Each SNP was analyzed for the presence of an association with peak and average tolerance. Multidimensional scaling plot, QQ-plot, and the genomic inflation factor were evaluated to identify population stratification using the quantitative measure of tolerance of $T_{Peak}$. No evidence for population stratification was observed (FIG. 11A). Strong evidence for association for $T_{Peak}$ was found with SNP BTB-00584953, located on BTA 15, at position 21,254,062 bp using the basic allelic model (unadjusted P=$1.8 \times 10^{-7}$; P=0.0079 after Bonferroni correction). A second SNP on BTA 15, located 2.8 Mb from BTB-00584953, was associated (P=$4.7 \times 10^{-5}$) with $T_{Peak}$. two other SNPs, located 79 Kb apart from each other on BTA 6, were found to have a moderate significance using the basic allelic model (unadjusted P=$3.8 \times 10^{-5}$). Similar to the quantitative measure of tolerance $T_{Peak}$, $T_{Average}$ did not show evidence for population stratification after analysis with the multidimensional scaling plot, QQ plots or the genomic inflation factor (FIG. 11B). Using the basic alleleic model, moderate evidence for association (P=$3.035 \times 10^{-6}$) for with $T_{Average}$ was shown with the same SNP on BTA 15 as was identified with $T_{Peak}$. Additional SNPs located on BTA 17 (unadjusted P=$2.68 \times 10^{-5}$), BTA 2 (unadjusted P=$3.8 \times 10^{-5}$), BTA 1 (unadjusted P=$4.5 \times 10^{-5}$) and BTA 16 (unadjusted P=$4.5 \times 10^{-5}$) also showed moderate evidence for association with $T_{Average}$.

REFERENCES CITED FOR THIS EXAMPLE 2, AND INCORPORATED HEREIN FOR THEIR RESPECTIVE TEACHINGS

1. APHIS Johne's Disease on U.S. Diaries 1991-2007 *Animal and Plant Health Inspection Service (APHIS).*, 2008, p 3.
2. Abubakar, I.; Myhill, D.; Aliyu, S. H. & Hunter, P. R. Detection of *Mycobacterium avium* subspecies *paratuberculosis* from patients with Crohn's disease using nucleic acid-based techniques: a systematic review and meta-analysis. *Inflamm Bowel Dis,* 2008, 14, 401-410
3. Alaniz, R. C.; Thomas, S. A.; Perez-Melgosa, M.; Mueller, K.; Farr, A. G.; Palmiter, R. D. & Wilson, C. B. Dopamine beta-hydroxylase deficiency impairs cellular immunity. Proc Natl Acad Sci, 1999, 96, 2274-2278
4. Banerjee, S. & Bond, J. S. Prointerleukin-18 is activated by meprin beta in vitro and in vivo in intestinal inflammation. J Biol. Chem., 2008
5. Burdon J J, M. W Measuring the cost of resistance to *Puccinia coronata* Cda in *Avena* fatua L. *Journal of Applied Ecology,* 1987, 24, 191-200.
6. Chiodini, R. J., V. K. H. & Merkal, R. Ruminant *paratuberculosis* (Johne's disease): the current status and future prospects. Ruminant *paratuberculosis* (Johne's disease): the current status and future prospects. *Cornell Vet.,* 1984, 74, 218-62.
7. Churchill G A, Doerge R W. Empirical threshold values for quantitative trait mapping. Genetics. 1994; 138:963-71.
8. Collins, M. T.; Gardner, I. A.; Garry, F. B.; Roussel, A. J. & Wells, S. J. Consensus recommendations on diagnostic testing for the detection of *paratuberculosis* in cattle in the United States. *J Am Vet Med Assoc,* 2006, 229, 1912-1919
9. Gonda, M. G.; Chang, Y. M.; Shook, G. E.; Collins, M. T. & Kirkpatrick, B. W. Effect of *Mycobacterium paratuberculosis* infection on production, reproduction, and health traits in US Holsteins. *Prev Vet Med,* 2007, 80, 103-119
10. Gonda, M. G.; Kirkpatrick, B. W.; Shook, G. E. & Collins, M. T. Identification of a QTL on BTA20 affecting susceptibility to *Mycobacterium avium* ssp. *paratuberculosis* infection in US Holsteins. *Anim Genet, Dairy Science,* 2007, 38, 389-396
11. Harris, N. B. & Barletta, R. G. *Mycobacterium avium* subsp. *paratuberculosis* in Veterinary Medicine. *Clin Microbiol Rev.* 2001, 14, 489-512
12. Imtiaz F, Savilahti E, Sarnesto A, Trabzuni D, Al-Kahtani K, Kagevi I, Rashed M S, Meyer B F, Järvela I. The T/G 13915 variant upstream of the lactase gene (LCT) is the founder allele of lactase persistence in an urban Saudi population. *J Med Genet,* 2007 oct, 44(10):e89.
13. Li, J.; Zhou, Y. & Elston, R. C. Haplotype-based quantitative trait mapping using a clustering algorithm. *BMC Bioinformatics,* 2006, 7, 258
14. Li, J.; Yu, L.; Shen, Y.; Zhou, L.; Wang, Y. & Zhang, J Inhibition of CXCR4 activity with AMD3100 decreases invasion of human colorectal cancer cells in vitro. World J Gastroenterol, 2008, 14, 2308-2313
15. Matukumalli, L. K.; Lawley, C. T.; Schnabel, R. D.; Taylor, J. F.; Allan, M.; Heaton, M. P.; O'Connell, J. R.; Sonstegard, T. S; Smith, T. P. L.; Moore, S. S, and Van Tassell, C. P. Development and characterization of a high density SNP genotyping assay for cattle. 2008. (Submitted)
16. Miller, M. R.; White, A. & Boots, M. The evolution of parasites in response to tolerance in their hosts: the good, the bad, and apparent commensalism. *Evolution,* 2006, 60, 945-956.
17. Nordlund, K. V.; Goodger, W. J.; Pelletier, J. & Collins, M. T. Associations between subclinical *paratuberculosis* and milk production, milk components, and somatic cell counts in dairy herds. *J Am Vet Med Assoc, Department of Medical Sciences,* 1996, 208, 1872-1876
18. Ott, S. L.; Wells, S. J. & Wagner, B. A. Herd-level economic losses associated with Johne's disease on US dairy operations. *Prev Vet Med,* 1999, 40, 179-192
19. Purcell S, Neale B, Todd-Brown K, Thomas L, Ferreira M A R, Bender D, Maller J, Sklar P, de Bakker P I W, Daly M J & Sham P C (2007) PLINK: a toolset for whole-genome association and population-bases linkage analysis. American Journal of Human Genetics, 81.

20. Smyth, R. H., C. G. & Smyth, R. H., C. G. Some observations on Johne's disease with a further note on the examination of fecal samples. *Vet Ret*, 1950, 62, 429-450

21. Sockett, D. C.; Carr, D. J. & Collins, M. T. Evaluation of conventional and radiometric fecal culture and a commercial DNA probe for diagnosis of *Mycobacterium paratuberculosis* infections in cattle. *Can J Vet Res.* 1992, 56, 148-153

22. Thony, B.; Blau, N.: Mutations in the GTP cyclohydrolase 1 and 6-pyruvoyl-tetrahydropterin synthase genes. *Hum. Mutat.* 1997, 10: 11-20.

23. Xu, J.; Zhang, S.; You, C.; Huang, S.; Cai, B. & Wang, X. Expression of human MCM6 and DNA Topo II alpha in craniopharyngiomas and its correlation with recurrence of the tumor. *J Neurooncol*, 2007, 83, 183-189.

24. Weiss, D. J.; Evanson, O. A. & Souza, C. D. Mucosal immune response in cattle with subclinical Johne's disease. *Vet Pathol, Department of Veterinary*, 2006, 43, 127-135 Wellcome Trust Case Control Consortium. Genome-wide association study of 14,000 cases of seven common diseases and 3,000 shared controls. Nature 2007, 447:661-78

25. Whitlock, R. H.; Wells, S. J.; Sweeney, R. W. & Tiem, J. V. ELISA and fecal culture for *paratuberculosis* (Johne's disease): sensitivity and specificity of each method. *Vet Microbiol*, 2000, 77, 387-398

26. Whitlock, R. H., Rosenberger, A. E., Sweeney, R. W., Spencer, P. A., Distribution of *M. paratuberculosis* in tissues of cattle from herds infected with Johne's disease. Proceedings of the Fifth International Colloquium on *Paratuberculosis*, 1996, 4:168-174.

27. Zanella, R., Settles, M., Fyock, T., Whitlock, R., Schukken, Y., Van Kessel, J., Karns, J., Hoving, E., Smith, J., Van Tassel, C., Gaskins, C. and Neibergs, H. Heritability of Genetic Tolerance to Johne's Disease *Poster ASAS, Indianapolis.*, 2008.

Example 3

Identification of Map Infection Linkage Disequilibrium Region, and Loci Associated with Tolerance to Johne's Disease in U.S. Holstein Cattle Overview.

Applicants have herein identified loci that are associated with tissue infection of cattle with Map (see also Applicants' Settles et al., doi:10.111/j.1365-2052.2009.01896.x publication; incorporated herein in its entirety for its teaches on these loci, mutants thereof, and diagnostic uses thereof).

Materials and Methods:

The population of animals used in the infection study was 245 Holstein cows from dairies in New York, Pennsylvania and Vermont that were followed to culling. Culling may have occurred for any reason, including having a Map positive diagnostic test. Fecal, ileum, ileo-cecal valve and two ileo-cecal lymph nodes were assessed for the presence of Map in each culled cow. An animal was considered tissue infected if a sample contained at least one colony-forming unit per gram of tissue (cfu/g). Fecal samples were also considered positive for Map if one or more cfu/g were detected. Each animal was genotyped with the Illumina BovineSNP50 BeadChip and after quality assurance filtering, 218 animals and 45,683 SNPs remained.

Figure 12:
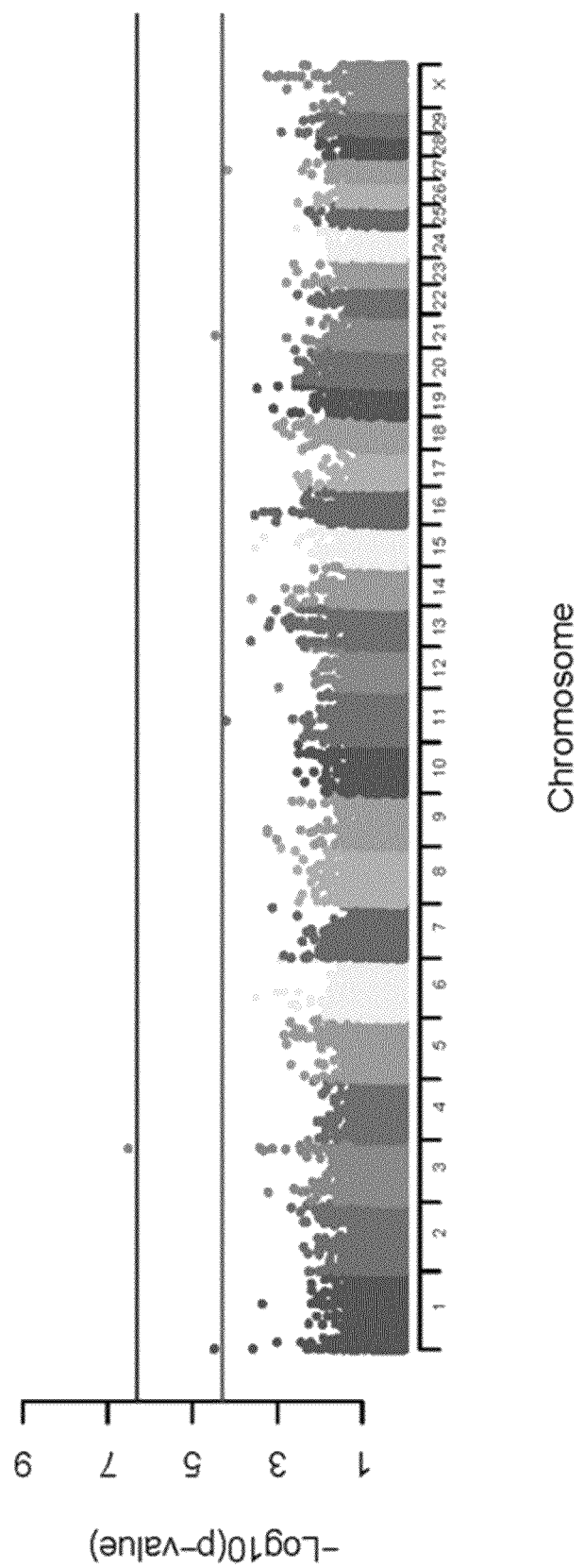
FIG. 12 shows a genome-wide plot of $-\text{Log }10$(P-values) for 45,683 SNPs tested for an association with *Mycobacterium avium* subspecies *paratuberculosis* (Map) infected tissue (tissue positive compared to tissue negative). Chromosomes 1-29 are shown. The horizontal dark grey line is drawn at $-\log 10(5 \times 10^{-5})$ and the horizontal black line is drawn at $-\log 10 (5 \times 10^{-7})$ to show those significant at the moderate and strong levels of significance, respectively. (Settles et al. 2009)

A case-control genome wide association study was conducted to test four different classifications of Map infection status (Cases) when compared to a Map negative control group (Control): presence of Map in the tissue, presence of Map in feces, presence of Map in both tissue and feces and presence of Map in tissue but not feces Results:

Regions on chromosomes 1, 5, 7, 8, 16, 21 and 23 were identified that showed moderate significance ($P<5\times10^{-5}$). A region on chromosome 3 (FIG. 12) was identified with a high level of association to the presence of Map in tissue ($P=3\times10^{-7}$, genome-wide Bonferonni correction for multiple testing $P<0.05$).

Figure 13:
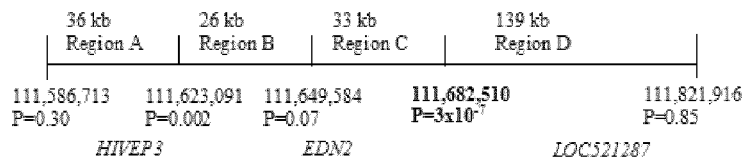
FIG. 13 shows the locations of single nucleotide polymorphisms (SNPs) (in base pairs) on bovine chromosome 3. The SNP at 111,682,510 (SS86341066) (in bold) was the most strongly associated with tissue infection ($P=3 \times 10^{-7}$).

A 235 kb region (SEQ ID NO:45) associated with Map tissue infection on chromosome 3 was defined by 3 genetic markers (single nucleotide polymorphisms or SNPs) where the evidence of association fell away in both directions (FIG. 13).

Figure 2:
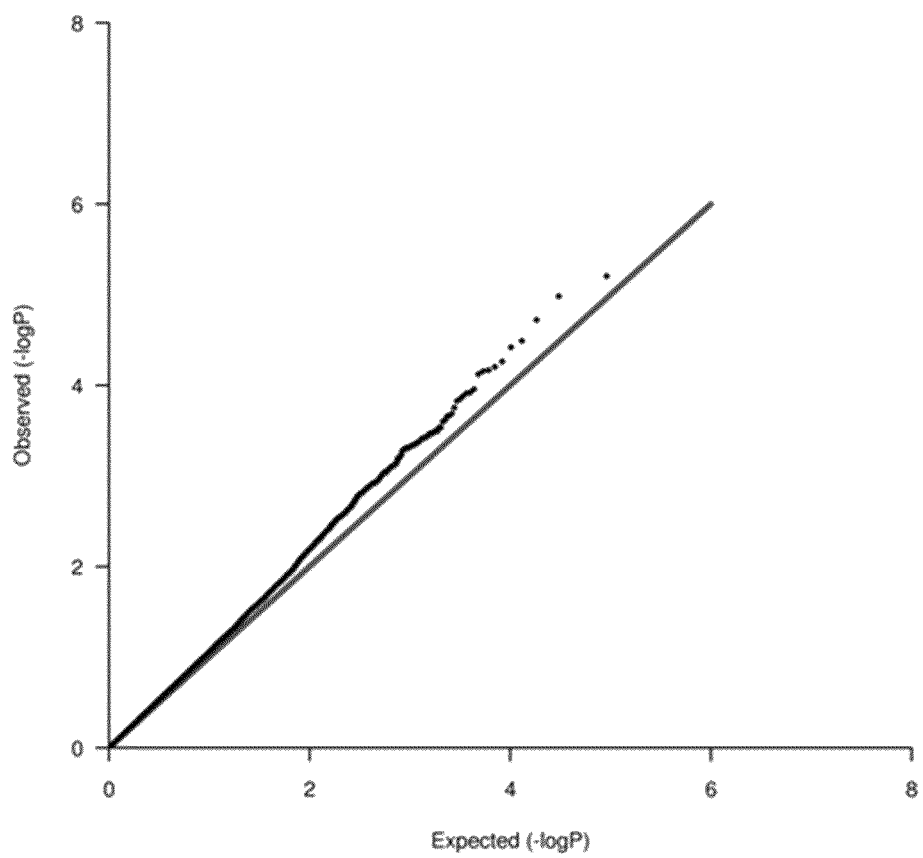
FIG. 2 shows a Q-Q plot for p-values from a 1-df test for association (allelic) versus expected for an association of loci with Map fecal positive (fecal positive versus fecal negative). The Q-Q plot shows evidence of a deviation from the expected null distribution of p-values and therefore evidence of population substructure.

FIG. 2 shows locations of single nucleotide polymorphisms (SNPs) (in base pairs) on bovine chromosome 3. The SNP at 111,682,510 (SS86341066) was the most strongly associated with tissue infection ($P=3\times10^{-7}$).

In particular preferred aspects, the 235 kb region (SEQ ID NO:45), or a 255,586 bp region (SEQ ID NO:1) of bovine chromosome 3, referred to herein at the inventive "Map infection linkage disequilibrium region" is disclosed to be associated with Map tissue infection ($P=7\times10^{-8}$), and is further characterized as including three functionally relevant genes: HIVEP3 (Human immunodeficiency virus type I enhancer-binding protein 3) (SEQ ID NO:2); EDN2 (Endothelin 2) (SEQ ID NO:3); and LOC521287 (*Bos taurus* similar to forkhead box O6) (SEQ ID NO:4), and the respective coding transcripts (SEQ ID NOS:5, 6 and 7, respectively), and polypeptides (SEQ ID NOS:8, 9 and 10, respectively).

Endothelin 2 (EDN2) (SEQ ID NO:3), one of only three genes in this region, resides within 37 kb of the most highly associated SNP on chromosome 3. This gene is known to have a physiological function in Crohn's disease in humans, is a potent vasoconstrictor and is a positive regulator of chemotaxis in macrophages in response to pathogens (refs). EDN2 binds to toll-like receptors inside the cell and may serve as an intracellular transporter. EDN2 (nucleotide sequence reference AB100737) has 3 known mutations in cattle, a cDNA of 1247 bp and a genomic sequence of 5924 bp (Benson et al. 2004). The EDN2 gene is conserved in human, chimpanzee, dog, mouse, rat, and chicken.

The second gene in this region is HIVEP3 (Human immunodeficiency virus type I enhancer-binding protein 3) (SEQ ID NO:2). HIVEP3 is a large gene that covers 54,554 nucleotides (111,560,078-111,614,632 bp) and ends near a SNP (111,623,091 bp on chromosome 3) that is associated ($P=0.0008$) with Map tissue infection. This gene produces proteins that bind specific DNA sequences, including the kappa-B motif (GGGACTTTCC), in the promoters and enhancer regions of several genes involved in immunity, inflammation, and growth. Expression of this gene correlates with the presence of viral antigens, mitogens, cytokines and viruses, including human immunodeficiency virus (HIV).

The LOC521287 (*Bos taurus* similar to forkhead box O6) (SEQ ID NO:4) gene is conserved in human, mouse, rat, and zebrafish.

Figure 19:
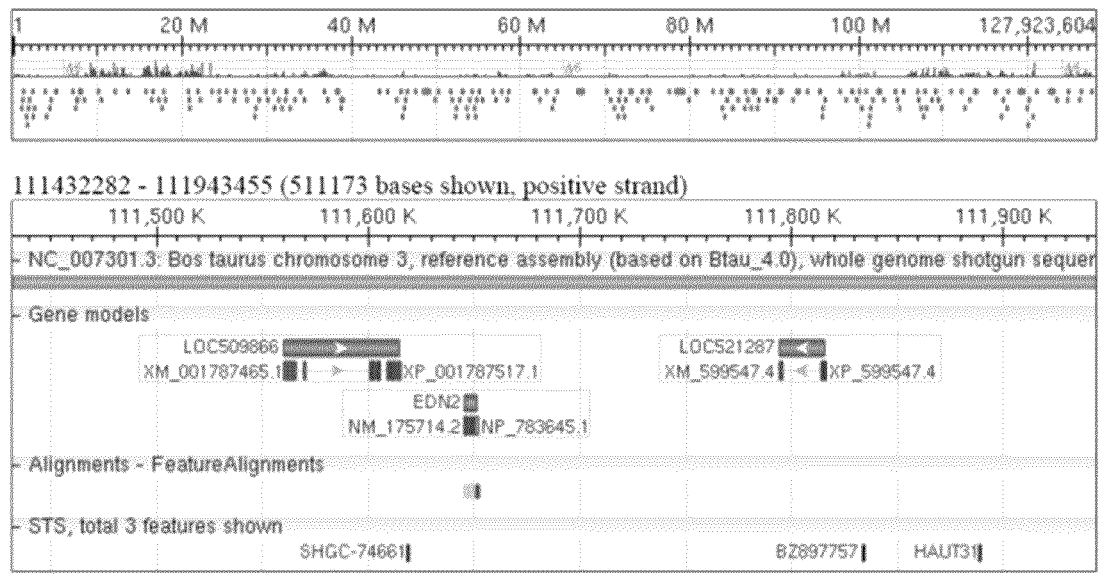
FIG. 19 shows a schematic of the region from chromosome 3 of *Bos taurus* from position 11432282-111943455 corresponding to NC_007301.3 (based on Btau 4.0).

The sequence information for these three genes is shown in Table 5. Additionally, FIG. 19 shows a schematic of the region from chromosome 3 of *Bos taurus* from position 11432282-111943455 corresponding to NC_007301.3 (based on Btau 4.0), which includes the HIVEP3 (Human immunodeficiency virus type I enhancer-binding protein 3) (SEQ ID NO:2); EDN2 (Endothelin 2) (SEQ ID NO:3); and LOC521287 (*Bos taurus* similar to forkhead box O6) (SEQ ID NO:4) genes.

TABLE 5

Sequence summary table showing position of the inventive linkage disequilibrium region, along with the HIVEP3, EDN2 and similar to forkhead box O6 subregions thereof, and including the respective GenBank accession and version numbers and corresponding SEQ ID NOS: 1-10.

| Region or Gene name | Gene sequence: Accession number; Version number; and chromosome 3 position (Btau 3.1) | mRNA sequence: Accession number; Version number; and chromosome 3 position | Protein sequence: Accession number and Version number, |
|---|---|---|---|
| Linkage disequilibrium region Or | NC_007301.3; GI: 194719407; 111,560,078 to 111,815,664 (255,586 bp) (SEQ ID NO: 1). | See below | See below |
| Linkage disequilibrium region HIVEP3 | NC_007301.3; GI: 194719407; 111,586,713 to 111,821,916 (235,204 bp) (SEQ ID NO: 45) | | |
| Bos taurus similar to human immunodeficiency virus type I enhancer binding protein 3 (LOC509866) | NC_007301.3; GI: 194719407; 111,560,078 to 111,614,644 (54,567 bp) (SEQ ID NO: 2) | XM_001787465.1; GI: 194665884; (mRNA processed 8,328 nt) (SEQ ID NO: 5) | XP_001787517.1; GI: 194665885; (2,775 amino acids) (SEQ ID NO: 8) |
| EDN2 (Bos taurus Endothelin 2) | NC_007301.3; GI: 194719407; 111,645,420 to 111,651,344 (5,925 bp) (SEQ ID NO: 3) | NM_175714.2; GI: 31342231 (1,249 by processed mRNA) (SEQ ID NO: 6) See also AB100737.1 GI: 27923033 (1,247 by processed mRNA) | NP_783645.1; GI: 28372485 (177 amino acid protein) (SEQ ID NO: 9) See also BAC55924.1 GI: 27923034 (177 amino acid protein) |
| Bos taurus similar to forkhead box O6 (LOC521287) | NC_007301.3; GI: 194719407; 111,794,197 to 111,815,664 (21,468 bp) (SEQ ID NO: 4) | XM_599547.4; GI: 194665886 (mRNA processed 1,608 nt) (SEQ ID NO: 7) | XP_599547.4; GI: 194665887 (535 amino acids) (SEQ ID NO: 10) |

Our genome-wide association study has provided us with strong evidence of association with Map tissue infection that comprised a 235 kb region (SEQ ID NO:45) (and a 255,586 bp region (SEQ ID NO:1)) on bovine chromosome 3. According to particular aspects, the EDN2, HIVEP3 and LOC521287 genes have, alone and/or in combination, functions that affect tissue infection of Map in cattle.

To confirm the association study and further characterize the association of Map tissue infection on chromosome 3, 42 additional SNPs were chosen from the NCBI SNP database (http://www.ncbi.nlm.nih.gov/projects/SNP/) to genotype the same animals that were used initially to identify the association of Map tissue infection on chromosome 3. Eighteen of the chosen 42 markers had minor allele frequencies less than 1% in the study animals and were removed from the analysis. Of the SNPs that remained, 17 were in region A in FIG. 2 (mean spacing between SNPs of 1682 bp), 2 in region B (mean spacing of 13,246 bp), 3 in region C (mean spacing of 10,975 bp) and 1 in region D (mean spacing of 69,703 bp). In relation to the genes in this region, exons 4 and 5 of HIVEP3 are located in region A, exons 1 through 4 of EDN2 are located in region B and exon 5 is located in region C. The LOC521287 (Bos taurus similar to forkhead box O6) (SEQ ID NO:4) gene is located to the right in region D. Unfortunately, only two SNPs 3' to SS86341066 (the SNP with the most evidence for an association with tissue infection) remained after removal of poorly performing or uninformative SNPs. This left a distance of 10 kb and 138 between the last two 3' SNPs in this region and SS86341066. Twenty-four markers (including a SNP in exon 4 of HIVEP3 and in two non-coding regions of EDN2) were analyzed for an association with tissue infection using chi square analysis.

Figure 14:
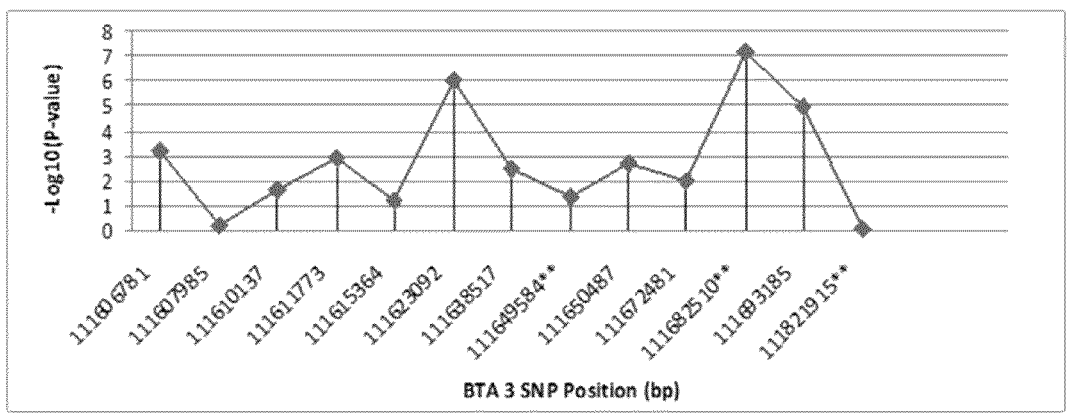
FIG. 14 shows an association analysis of an 82 kb region of chromosome 3. Location of SNPs in basepairs are listed on the x axis and the $-\log 10$ (p value) of the association of each SNP with Map tissue infection is listed on the y axis. A $-\log 10$ value of 1.2 represents $P=0.05$. SNPs with the greatest evidence for association with Map tissue infection include the SNP at 111,623,092 ($P=9.4 \times 10^{-7}$), the adjacent 3' SNP 111,693,185 ($P=1.1 \times 10^{-5}$) and the SNP located between HIVEP3 and EDN2 at 111,682,510 bp ($P=7.5 \times 10^{-8}$). SNPs that are marked with ** indicate SNPs that were first analyzed with the use of the Illumina bovine SNP50 BeadChip and were also included in the fine mapping of additional SNPs in this region.

A large region near SS86341066 was found to be associated with Map tissue infection after analysis with the 24 additional SNPs. Thirteen SNPs were associated ($P<0.05$) with Map tissue infection over the 235 kb region. In a region of 83 kb (111,610,137 to 111,693,185 bp; from Btau assembly 3.1) (SEQ ID NO:47) encompassing SNPs for HIVEP3, EDN2 and SS86341066, ten of ten SNPs were associated with Map tissue infection (FIG. 14) including three SNPs with particularly strong evidence for association ($P<2\times10^{-5}$).

Figure 3:
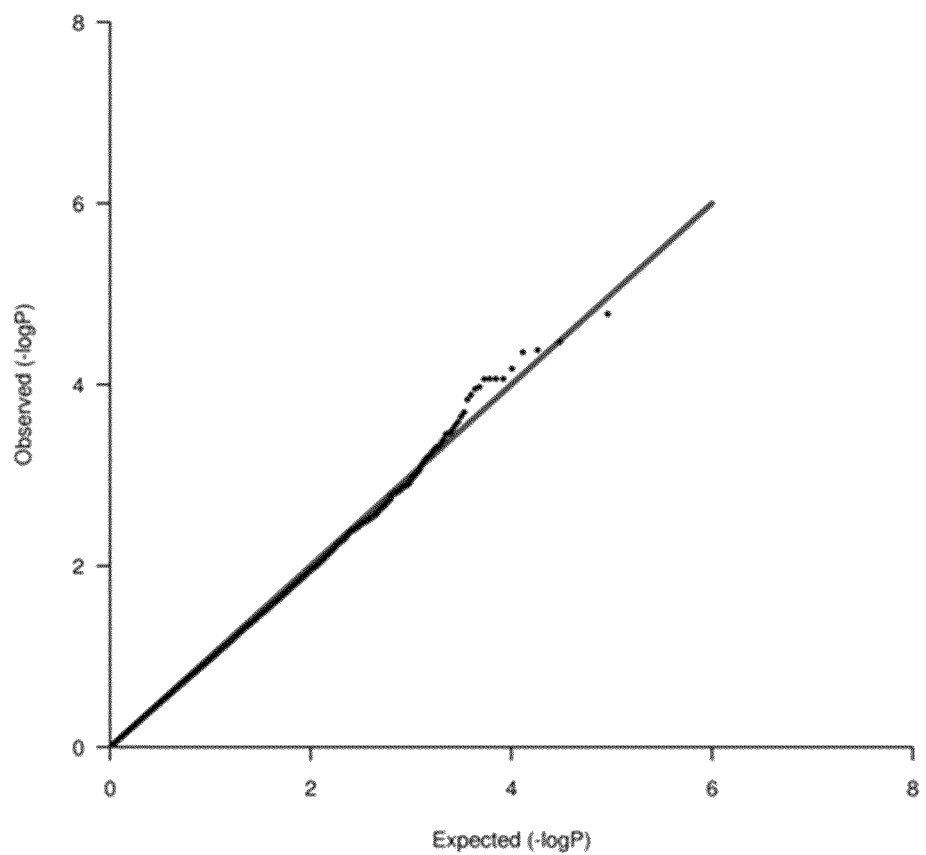
FIG. 3 shows a Q-Q plot for stratified test of association (2×2×4 CMH test) within herd versus expected for an association of loci with Map fecal positive (fecal positive versus fecal negative). The Q-Q plot shows little to no evidence of a deviation from the expected null distribution of p-values and therefore no evidence of population substructure.

FIG. 3 shows an association analysis of an 83 kb region of chromosome 3. Location of SNPs (in by with respect to NC 007301.3) are listed on the x axis and the $-\log 10$ (p value) of the association of each SNP with Map tissue infection is listed on the y axis. A $-\log 10$ value of 1.2 represents $P=0.05$. SNPs with the greatest evidence for association with Map tissue infection include the SNP at 111,623,092 ($P=9.4\times10^{-7}$), the adjacent 3' SNP 111,693,185 ($P=1.1\times10^{-5}$) and the SNP located between HIVEP3 and EDN2 at 111,682,510 bp ($P=7.5\times10^{-8}$). SNPs that are marked with "**" indicate SNPs that were first analyzed with the use of the Illumina bovine SNP50 BeadChip™ and were also included in the fine mapping of additional SNPs in this region.

The association of these SNPs with Map tissue infection is due to linkage disequilibrium. Linkage disequilibrium (LD) refers to correlations among neighboring alleles, reflecting haplotypes descended from single, ancestral chromosomes. Groups of adjacent alleles that have been inherited together can be used to identify genes that cause disease. In the cattle genome, genome-wide LD extends up to an average of 100 kb. This means that within a 100 kb region, it is expected that most of the nucleotides will be inherited together as a block with little recombination or deterioration of LD between the nucleotides over individual generations. Over time, however, LD will slowly deteriorate because of the process of recombination in meiosis. In this process, SNPs that were due to mutations that occurred a long time ago are more likely to have fallen out of LD than SNPs in the same region that are fairly new.

The analysis of SNPs associated with a disease in cattle within a region smaller than 100 kb must considered carefully. Individual SNPs may not provide strong evidence for an association with the disease because that particular SNP may be much older than a nearby "new" SNP that remains in LD with the disease. Because the age of the SNPs are unknown, evaluating the trends of LD within a genomic region of 100 kb or less is particularly helpful. Therefore, it is most important to evaluate the entire region of interest that is associated with the disease rather than solely targeting the DNA immediately adjacent to the SNP with the most evidence for an association. The fine mapping results shown here provide extremely strong evidence of a region and locus that is responsible for differences in Map tissue infection in Holstein cows because an entire block of SNPs are associated with the disease.

Haplotypes were further analyzed for the 83 kb region where the evidence for an association to Map tissue infection was strongest. A haplotype represents the linear arrangement of alleles of the SNPs on one of the two chromosomes in a pair of chromosomes that a cow inherits from her dam or sire. In this haplotype analysis, the complement of alleles on chromosome 3 inherited from the mother (maternal haplotype), and the complement of alleles on chromosome 3 inherited from the father (paternal haplotype) are evaluated separately. The frequencies of the maternal and paternal haplotypes of the Map infected cows are then compared to the haplotype frequencies of the cows that are uninfected.

Figure 15:
FIG. 15 shows a schematic of the location of the genetic markers, and their alleles to form a haplotype over an 86 kb region on bovine chromosome 3. The haplotype shown was only seen in animals with Map tissue infection. Similarly, six haplotypes were only seen in cows without Map tissue infection (23%). Bolded alleles indicate markers found to exclusively segregate with resistance to Map tissue infection.

Alleles from 11 SNPs comprised a single haplotype in the 86 kb region (SEQ ID NO:48) (FIG. 15). Twenty-five different combination of alleles for the 11 SNPs were observed and distinct differences were detected between the haplotype frequencies of Map tissue infected animals and uninfected animals ($P=2.2\times10^{-7}$). The differences in these frequencies demonstrated that certain SNPs in this region were inherited together as a single ancestral block on chromosome 3. This ancestral block also segregated with Map tissue infection. This block represents eleven SNPs and pinpoints, with very high probability, an underlying sequence that harbors a mutation(s) responsible for resistance to Map.

Alleles of five SNPs (FIG. 15), shown in bold face type, were different between every Map tissue infected and uninfected cow. Four of these SNPs are adjacent to or span exons in HIVEP3. This data provides strong evidence that this region harbors a mutation that is associated with resistance to Map tissue infection, located in or near exon four or five of HIVEP3.

The data disclosed herein, provide strong evidence of mutations in a 235 kb region (SEQ ID NO:45) (and a 255,586 bp region (SEQ ID NO:1) on bovine chromosome 3) that are associated with Map tissue infection, a critical step in the pathogenic process leading to Johne's disease. The 235 kb region was further characterized by increasing the density of SNPs in this area to elucidate a more refined profile of the genome associated with Map tissue infection. This profile confirmed Applicants' initial association results, and identified a haplotype comprising 76 kb (SEQ ID NO:46), from about 111,606,511 to 111,682,511, or from about 111,606,781 to 111,682,511 (comprising 5 SNPs; assembly Btau 3.1) as particularly preferred region(s) harboring one or more mutation(s) responsible for the resistance of cattle to Map tissue infection. The identification of the linkage disequilibrium regions and mutation(s) disclosed herein provides for compositions and methods for susceptibility, resistance or tolerance to infection by *Mycobacteria* and *Paratuberculosis*, and hence to Johne's disease through Map tissue infection.

Example 4

Causative Mutations or Genotypes of a Single Nucleotide Polymorphisms (SNPs) within the Endothelin 2 (EDN2) Gene that Segregate with Resistance or Tolerance to Map Tissue Infection in, for Example, Holstein and Jersey Cattle, were Identified Overview.

Applicants have herein identified causative loci that are associated with tissue infection of cattle with Map. The objective of this Example 4 was to identify causative mutations responsible for the association of Map tissue infection in, for example, Holstein and Jersey cattle. To determine this, re-sequencing of the 70 kb region on BTA3 in Jersey and Holstein cattle was performed, which identified 528 SNPs. These were further evaluated by comparing conservation of the DNA sequence variants across species for known functional motifs. An assay was developed to test the association of 96 SNPs that were either highly conserved or provided evidence of possible functional differences between alleles. Eighteen SNPs associated with Map tissue infection were tested for putative functional differences by electrophoretic mobility shift assays. Two SNPs were identified to alter the binding activities of nuclear proteins. These changes also increased transcriptional activity of a luciferase reporter construct, which was consistent with the mobility shift changes. These findings are consistent with other studies, and for the first time indicate that the majority of causative mutations are due to alterations in gene expression regulation. The selection of animals that are less susceptible to Map tissue infection provides a complementary approach to reduce the prevalence of Johne's disease in dairy cattle.

Materials and Methods:

Holstein and Jersey Population.

The exemplary Holstein population used in the fine mapping association study consisted of the same animals used for the initial genome-wide association and fine mapping analyses previously described (Neibergs et al. 2010; Settles et al. 2009; Zanella et al. 2011). Briefly, tissue and fecal samples from 221 unrelated Holstein cows from four dairy herds located in the eastern United States were harvested at slaughter and cultured for the presence of Map. To determine if the animals were Map tissue infected, Map was cultured from tissues taken from the ileum, ileo-cecal valve and two adjacent ileo-cecal lymph nodes using the method described by Whitlock et al. (1996). Samples with colony forming units (cfus) of Map >0 were classified as Map infected. After genotyping and filtering for quality control, 90 animals remained that were classified as Map tissue infected (cases) and 120 animals were classified as Map tissue negative (controls).

The exemplary Jersey population used in the fine mapping association study consisted of 51 cows from a dairy in Northern Oregon and 9 steers from a dairy in Pennsylvania. Fecal and tissue samples from ileum and ileo-cecal lymph nodes were harvested at slaughter, and the determination of the infection status of the animals was conducted using the AgPath-ID™ real-time qPCRr using 300 mg of tissue sample (ileo-cecal lymph node and ileum) for the Northern Oregon animals. The AgPath-ID™ real-time qPCR was validated in samples with tissue culture results prior to being used in samples with and unknown infection status. Quantitative PCR results were also confirmed in a subset of samples with qPCR results from the Washington State University Veterinary diagnostic laboratory. Animals with Map DNA copies/µl greater than 1 in at least one of the tissues were considered Map infected. After genotyping and filtering for quality control, 15 animals remained that were classified as Map tissue infected (cases), 41 animals were classified as Map tissue negative (controls).

Development of Single Nucleotide Polymorphism Selection Custom Array.

Single nucleotide polymorphisms were identified through sequencing of ten Jersey and ten Holstein animals. Five hundred twenty-eight (528) SNPs were identified on BTA3 in the region of 105,276,106 bp to 105,346,965 bp (assembly UMD 3.1), with a median spacing of 132 bp between SNPs. A custom 96-SNPs assay (Illumina, San Diego, Calif.) was designed for the genotyping of this approx. 70 kb region (70.86 kb) on BTA3. The selection of 96 SNPs was based on a lack of repetitive regions surrounding the SNP, their nucleotide location based on the UMD 3.1 assembly, SNP with high minor allele frequency (MAF), whether the SNP had been validated (if they had not been validated, SNP with confirmation of sequence variation in more than one breed were preferred), conservation of sequences around the SNP across several species, the presence of transcription or other regulatory motifs (using the Transcription Factor Database or Transfac, Salt Lake City, Utah) and through the selection of sequences with scores >70 utilizing the Illumina (San Diego, Calif.) assay design tool (Liu et al. 2009).

Genotyping and Quality Assurance.

DNA was extracted from tissue of each animal using the Puregene DNA extraction kit as per manufacturer's instructions (Gentra, Minneapolis, Minn.). DNA was quantified using the Nanodrop (Wilmington, Del.) 1000 spectrophotometer and genotyped at Igenix (Seattle, Wash.) using the 96-SNPs custom array. Genotypes were called using Illumina's (San Diego, Calif.) BeadStudio (v3.2.23) software. Samples were removed from the analysis when more than 10% of their genotypes failed. SNPs were removed if the minor allele frequency was less than 1%, the call rates of SNPs were less than 10%, or the SNPs failed the Hardy-Weinberg equilibrium test ($P<0.001$).

To test for population stratification between the cases and controls prior to the association analysis, multi-dimensional scaling (MDS) plots were constructed using PLINK (version 1.07) in the R statistical environment for the Holstein and Jersey populations (Purcell et al. 2007).

Association Analysis.

An allelic chi-square test was performed using PLINK (version 1.07) between SNPs to identify loci associated with Map infection (Purcell et al. 2007). Two separate comparisons were made between: 1) cases and controls using only the Holstein population and 2) cases and controls using only the Jersey population. A significance threshold for the association analysis of $P<0.05$ was used after $1.0\times10^6$ permutations comparing each observed test statistic against the maximum of all permuted statistics over all SNPs for each single replicate. The linkage disequilibrium levels between SNPs were computed using the D' function in Haploview 4.2 (Barrett et al. 2005).

Cell Culture, Transfection and Dual Luciferase Reporter Assay.

Human embryonic kidney (HEK293) cells were cultured in DMEM medium supplemented with 10% FBS, 100 units/ml penicillin and 100 m/ml streptomycin. Cells were maintained at 37 C in a humidified atmosphere of 95% air and 5% $CO_2$. HEK293 cells were seeded at $1\times10^5$ cells per well in a 24-well plate the day before transfection and co-transfected with 0.8 µg of the luciferase reporter construct and 0.1 µg of pRL-TK (*Renilla luciferase*) plasmid. Thirty hours after transfection, firefly and *Renilla luciferase* activities were measured consecutively using a dual luciferase assay kit (Promega, Madison, Wis.). *Renilla luciferase* values were normalized to firefly and the ratio of *Renilla*/firefly values was reported. Each experiment was carried out more than three times with triplicate replicates.

SNP Constructs 5' to EDN2.

PCR fragments containing either the G or T allele of the SNP208 located at 105,298,664 bp (UMD 3.1) were amplified from individuals whose genomic DNA was homozygous for the allele. The PCR primer sequence for the sense strand was 5'-ATCTCGAGGGAGCCCCTCCATCACTCTGCCTTT-3' (SEQ ID NO:49) and for the antisense strand was 5'CTAAGCTTGGCGACCACAGTGGTGAGGCACGCT-3' (SEQ ID NO:50). The amplified 779 bp products were cloned into pGL3-basic vector (Promega, Madison, Wis.) between XhoI and HindIII restriction endonuclease sites. The sequences of the cloned PCR fragments containing the expected G or T allele of SNP208 were verified by sequencing of both the sense and antisense strands.

MicroRNA SNP Site.

Putative target sites for miRNA in the 3'-UTR of bovine EDN2 mRNA were screened using Targetscan (www.targetscan.org). SNP272 is located at 105,305,070 bp on BTA3 (UMD 3.1) or 420 bp downstream from the termination codon of EDN2. Two microRNAs (bta-miR-2339 and bta-miR-1197) were identified at positions of 416-422 bp and 420-426 bp of EDN2 3'-UTR, respectively. MicroRNA precursors (bta-miR-1197 and bta-miR-23390) and the negative control were purchased from Ambion (Austin, Tex.). The 3'-UTR sequence of EDN2 was PCR amplified from bovine genomic DNA and subsequently cloned into the multiple cloning sites (XhoI and NotI) distal to the *Renilla luciferase* coding region of the psiCHECK-2 vector (Promega, Madison, Wis.). Two cattle genomic DNAs that were homozygous for the A or G allele at SNP272 were used as the PCR template. The sequences of two PCR primers were: 5'-ATCTCGAGCTCTCGACTCTGGGAGAACTTTGGGAAG-3' (SEQ ID NO:51) from the sense strand and 5'-ATGCGGCCGCATTATTTTGTTGTTTAT-TACAAACACAAGTTCGCA-3' (SEQ ID NO:52) for the antisense strand. The SNP272 construct sequence from the EDN2 3'-UTR was confirmed by double-stranded sequencing. HEK293 cells were co-transfected with 50 nmol/L miRNA and 200 ng of psiCHECK-2 constructs, using Lipofectamine 2000 (Invitrogen, Carlsbad, Calif.). The assay for firefly and *Renilla* luciferase activities was the same as described above.

Eletrophoretic Mobility Shift Assays (EMSAs).

Nuclear extracts were prepared from cattle ileo-caecal lymph node using NE-PER Nuclear and Cytoplasmic Extraction Reagents (Pierce, Rockford, Ill.) according to the manufacturer's instructions. The EMSAs were performed using the LightShift™ Chemiluminescent EMSA kit (Pierce, Rockford, Ill.) according to the manufacturer's instructions. A 31 bp sense and anti-sense strand for each SNP allele was synthesized, biotin-labeled and annealed to generate the double-stranded oligonucleotides (Table 7). Probes were incubated with poly (dI-dC) for 3 minutes at room temperature, and then incubated with 20 μg of nuclear extract for an additional 20 minutes. The products were then separated by electrophoresis on a 6% non-denaturing polyacrylamide gel with 0.5× tris-borate-EDTA buffer. The protein-oligonucleotide complexes were visualized by auto-radiography. For competition studies, unlabeled oligonucleotide probes of 5-125-fold excess were pre-incubated with the nuclear extract before the biotin-labeled probes were added. All EMSAs were repeated three times to check for reproducibility.

TABLE 7

SNP listing, showing chromosomal location (BTA3 (UMD 3.1)), alleles, sense and anti-sense oliognucliotides specific to the SNP alleles and respective SEQ ID NOS.

| SNP | Location | | Allele "S" is susceptible "NS" is non-susceptible | Sense oligonucleotides | Anti-sense oligonucleotides |
|---|---|---|---|---|---|
| SNP28 | 105279109 | 5' flanking region | C (NS) | AGGATTACTCAGACACAGCCTGGGAAAACCG SEQ ID NO: 53 | CGGTTTTCCCAGGCTGTGTCTGAGTAATCCT SEQ ID NO: 54 |
| | | | T (S) | AGGATTACTCAGACATAGCCTGGGAAAACCG SEQ ID NO: 55 | CGGTTTTCCCAGGCTATGTCTGAGTAATCCT SEQ ID NO: 56 |
| SNP30 | 105279358 | 5' flanking region | C (NS) | GCGAGGGCTGCACTGCGGGAGTCAGTTTATC SEQ ID NO: 57 | GATAAACTGACTCCCGCAGTGCAGCCCTCGC SEQ ID NO: 58 |
| | | | G (S) | GCGAGGGCTGCACTGGGGGAGTCAGTTTATC SEQ ID NO: 59 | GATAAACTGACTCCCCCAGTGCAGCCCTCGC SEQ ID NO: 60 |
| SNP66 | 105284915 | 5' flanking region | C (NS) | GACCTCGTTGTCCAGCACGAGACTCAGGGGA SEQ ID NO: 61 | TCCCCTGAGTCTCGTGCTGGACAACGAGGTC SEQ ID NO: 62 |
| | | | T (S) | GACCTCGTTGTCCAGTACGAGACTCAGGGGA SEQ ID NO: 63 | TCCCCTGAGTCTCGTACTGGACAACGAGGTC SEQ ID NO: 64 |
| SNP78 | 105286393 | 5' flanking region | G (NS) | GATTTGGTTCAACAAGCCTTCAAACCACCTT SEQ ID NO: 65 | AAGGTGGTTTGAAGGCTTGTTGAACCAAATC SEQ ID NO: 66 |
| | | | A (S) | GATTTGGTTCAACAAACCTTCAAACCACCTT SEQ ID NO: 67 | AAGGTGGTTTGAAGGTTTGTTGAACCAAATC SEQ ID NO: 68 |
| SNP80 | 105286650 | 5' flanking region | G (NS) | GATCTGTCCTGTGTCGGGGTCAGAGGCTTGC SEQ ID NO: 69 | GCAAGCCTCTGACCCCGACACAGGACAGATC SEQ ID NO: 70 |
| | | | A (S) | GATCTGTCCTGTGTCAGGGTCAGAGGCTTGC SEQ ID NO: 71 | GCAAGCCTCTGACCCTGACACAGGACAGATC SEQ ID NO: 72 |
| SNP105 | 105288174 | 5' flanking region | G (NS) | CAAAAGGCTCCCAGTGTGTCTTCCAGGTGCT SEQ ID NO: 73 | AGCACCTGGAAGACACACTGGGAGCCTTTTG SEQ ID NO: 74 |
| | | | A (S) | CAAAAGGCTCCCAGTATGTCTTCCAGGTGCT SEQ ID NO: 75 | AGCACCTGGAAGACATACTGGGAGCCTTTTG SEQ ID NO: 76 |
| SNP109 | 105288737 | 5' flanking region | C (NS) | TGGCCTCCTGGCTGGCGACGGCTGCCTCTCT SEQ ID NO: 77 | AGAGAGGCAGCCGTCACCAGCCAGGAGGCCA SEQ ID NO: 78 |
| | | | T (S) | TGGCCTCCTGGCTGGTGACGGCTGCCTCTCT SEQ ID NO: 79 | AGAGAGGCAGCCGTCACCAGCCAGGAGGCCA SEQ ID NO: 80 |
| SNP128 | 105291541 | 5' flanking region | C (NS) | GGTCTGACACCAGAACCAGAGACCTTAGCTA SEQ ID NO: 81 | TAGCTAAGGTCTCTGGTTCTGGTGTCAGACC SEQ ID NO: 82 |
| | | | G (S) | GGTCTGACACCAGAAGCAGAGACCTTAGCTA SEQ ID NO: 83 | TAGCTAAGGTCTCTGCTTCTGGTGTCAGACC SEQ ID NO: 84 |
| SNP137 | 105291983 | 5' flanking region | T (NS) | CCTTTTTGATGGGCCTTGAGTTTGGGCAAAA SEQ ID NO: 85 | TTTTGCCCAAACTCAAGGCCCATCAAAAAGG SEQ ID NO: 86 |
| | | | A (S) | CCTTTTTGATGGGCCATGAGTTTGGGCAAAA SEQ ID NO: 87 | TTTTGCCCAAACTCATGGCCCATCAAAAAGG SEQ ID NO: 88 |
| SNP146 | 105292844 | 5' flanking region | G (NS) | GGCAGCCAGAGCAGCGGAGCCTCAGAGATTC SEQ ID NO: 89 | GAATCTCTGAGGCTCCGCTGCTCTGGCTGCC SEQ ID NO: 90 |
| | | | A (S) | GGCAGCCAGAGCAGCAGAGCCTCAGAGATTC SEQ ID NO: 91 | GAATCTCTGAGGCTCTGCTGCTCTGGCTGCC SEQ ID NO: 92 |
| SNP170 | 105295131 | 5' flanking region | C (NS) | AAGGGGGTGTCCTCCCGGGGAAGCCGCAAAG SEQ ID NO: 93 | CTTTGCGGCTTCCCCGGGAGGACACCCCCTT SEQ ID NO: 94 |
| | | | T (S) | AAGGGGGTGTCCTCCTGGGGAAGCCGCAAAG SEQ ID NO: 95 | CTTTGCGGCTTCCCCAGGAGGACACCCCCTT SEQ ID NO: 96 |

TABLE 7-continued

SNP listing, showing chromosomal location (BTA3 (UMD 3.1)), alleles, sense and anti-sense oliognucliotides specific to the SNP alleles and respective SEQ ID NOS.

| SNP | Location | | Allele "S" is susceptible "NS" is non-susceptible | Sense oligonucleotides | Anti-sense oligonucleotides |
|---|---|---|---|---|---|
| SNP180 | 105296189 | 5' flanking region | G (NS) | TACACTGGTGTGCAGGAAAGGGTGAGTCTGG SEQ ID NO: 97 | CCAGACTCACCCTTTCCTGCACACCAGTGTA SEQ ID NO: 98 |
| | | | A (S) | TACACTGGTGTGCAGAAAAGGGTGAGTCTGG SEQ ID NO: 99 | CCAGACTCACCCTTTTCTGCACACCAGTGTA SEQ ID NO: 100 |
| SNP181 | 105296223 | 5' flanking region | G (NS) | AGTAGCCCGGAGAGTGTGTCCAGCCCATCAC SEQ ID NO: 101 | GTGATGGGCTGGACACACTCTCCGGGCTACT SEQ ID NO: 102 |
| | | | A (S) | AGTAGCCCGGAGAGTATGTCCAGCCCATCAC SEQ ID NO: 103 | GTGATGGGCTGGACATACTCTCCGGGCTACT SEQ ID NO: 104 |
| SNP183 | 105296667 | 5' flanking region | C (S) | GAGGCATAGAGGTGACTGTCGGGGCCCAGGC SEQ ID NO: 105 | GCCTGGGCCCCGACAGTCACCTCTATGCCTC SEQ ID NO: 106 |
| | | | G (NS) | GAGGCATAGAGGTGAGTGTCGGGGCCCAGGC SEQ ID NO: 107 | GCCTGGGCCCCGACACTCACCTCTATGCCTC SEQ ID NO: 108 |
| SNP190 | 105297461 | 5' flanking region | T (S) | TTTTACTTTCTCAAATCCAAGTTCTTTCCTT SEQ ID NO: 109 | AAGGAAAGAACTTGGATTTGAGAAAGTAAAA SEQ ID NO: 110 |
| | | | A (NS) | TTTTACTTTCTCAAAACCAAGTTCTTTCCTT SEQ ID NO: 111 | AAGGAAAGAACTTGGTTTTGAGAAAGTAAAA SEQ ID NO: 112 |
| SNP208 | 105298664 | 5' flanking region | T (S) | CTTTTGGTGTACATATCCACAAGCCACCTTT SEQ ID NO: 113 | AAAGGTGGCTTGTGGATATGTACACCAAAAG SEQ ID NO: 114 |
| | | | G (NS) | CTTTTGGTGTACATAGCCACAAGCCACCTTT SEQ ID NO: 115 | AAAGGTGGCTTGTGGCTATGTACACCAAAAG SEQ ID NO: 116 |
| SNP264 | 105304227 | intron | A (NS) | AGGTCAACAGCCTGAAGAGCCACAGGGATAG SEQ ID NO: 117 | CTATCCCTGTGGCTCTTCAGGCTGTTGACCT SEQ ID NO: 118 |
| | | | G (S) | AGGTCAACAGCCTGAGGAGCCACAGGGATAG SEQ ID NO: 119 | CTATCCCTGTGGCTCTTCAGGCTGTTGACCT SEQ ID NO: 120 |
| SNP272 | 105305070 | 3'-UTR | G (NS) | AGCCCTCGCTCTCCAGTGTCCTTATTCTCCC SEQ ID NO: 121 | GGGAGAATAAGGACACTGGAGAGCGAGGGCT SEQ ID NO: 122 |
| | | | A (S) | AGCCCTCGCTCTCCAGTGTCCTTATTCTCCC SEQ ID NO: 123 | GGGAGAATAAGGACATTGGAGAGCGAGGGCT SEQ ID NO: 124 |

Results:

Re-Sequencing Region Around Ss86341066.

Applicants' initial genome-wide association study identified a region around SNP ss86341066 on BTA3 with significant association to Map tissue infection (Settles et al. 2009). A subsequent fine-mapping study of 42 SNPs across a 235 kb refined this region to an area bordered by HIVEP3 and EDN2. The SNP ss86341066 remained the SNP with the strongest association with Map tissue infection after the addition of the 42 SNP markers (Zanella et al. 2011). To try to identify a causal mutation responsible for the association of Map tissue infection, ten Jersey and ten Holsteins were sequenced over a ~70 kb region (BTA3: 105,276,106-105,346,965 bp; (UMD 3.1)). In this region, 528 variants were identified with a median spacing of 132 bp between SNPs. The non-coding region between HIVEP3 and EDN2 is highly conserved with blocks of conservation that exceed the conservation of the coding regions of HIVEP3 and EDN2. Applicants determined that this region is replete with transcription factor sites and over 100 putative functional modifications that modify binding of transcription binding factors based on in silico analysis of the DNA variants observed. A custom 96 SNP Illumina (San Diego, Calif.) assay was developed based on the evolutionary conservation of each SNP across species, the potential modification of transcription factors, minor allele frequencies of the SNPs in Jersey and Holsteins, lacks of repetitive sequence around SNPs and a minimum Illumina assay design scores of 70.

Fine-Mapping.

Igenix (Seattle, Wash.) performed genotyping using the custom 96 SNP Illumina assay with samples from 221 Holstein and 60 Jersey cattle in which Map tissue infection was known. Quality control was conducted on samples and genotypes. For the Holstein cattle population, 9 were removed because of a low genotyping call rate (<0.1). Of the SNPs genotyped, 39 SNPs were excluded because of a low MAF (<0.01), 7 SNPs were removed because of low (<0.9) genotyping call rate, and 6 SNPs were excluded because they failed the Hardy Weinberg Equilibrium test (P<0.001), leaving 44 SNPs for the association analysis. No population stratification was detected among the Holsteins in this study using multi-dimensional scaling plots and principal component analysis. An allelic chi-square test was conducted to determine if there was association between Map tissue infection and the remaining SNPs. Twenty-four SNPs were found to be associated with Map tissue infection (see FIG. 21), with SNP 272 showing the strongest association ($P<9.9\times10^{-5}$).

Figure 21:
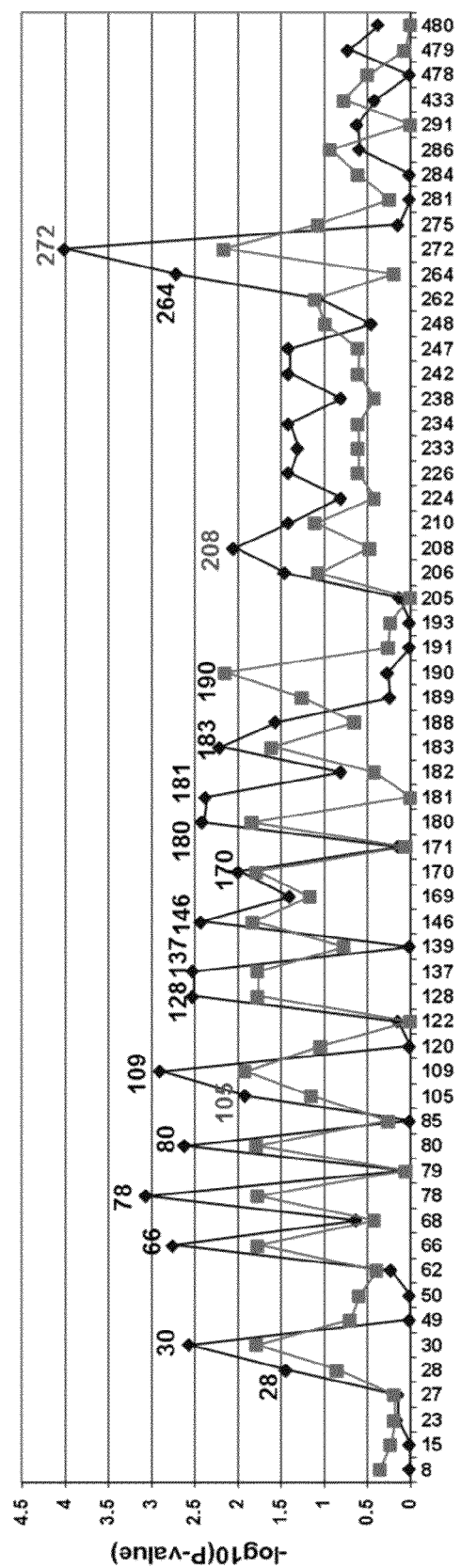
FIG. 21 shows fine mapping of Holstein (blue) and Jersey (lavender) cows of 70 kb region on BTA3. Significant SNPs were examined by EMSA. SNPs in red were further evaluated.

For the Jersey cattle genotyped, four were removed from the analysis because of a low genotyping call rate (<0.9). Of the SNPs genotyped, 9 SNPs were excluded because of a low MAF (<0.01), 30 SNPs were removed because of a low (<0.9) genotyping call rate and 4 SNPs were excluded because they failed the Hardy Weinberg Equilibrium test (P<0.001) leaving 53 SNPs for the association analysis. Population stratification was not detected for Jersey in this study using multi-dimensional scaling plots and principal component analysis. An allelic chi-square test was conducted to determine if there was association between Map tissue infection and the remaining SNPs. Thirteen SNPs were identified to be associated with Map tissue infection in the Jersey cattle evaluated. As shown in FIG. 21, most of the significant SNPs are shared by both breeds with SNP272 showing the strongest association ($P<6.8\times10^{-3}$). The 18 SNPs most strongly associated with Map tissue infection were chosen for further functional analysis. These SNPs were in linkage disequilibrium ($r^2>0.9$) with each other with the exception of SNP190. SNP272 was located in the 3'-UTR of EDN2 and SNP264 in the intron while the remaining SNPs were located 5' to EDN2.

Figures 22A, 22B, 22C:
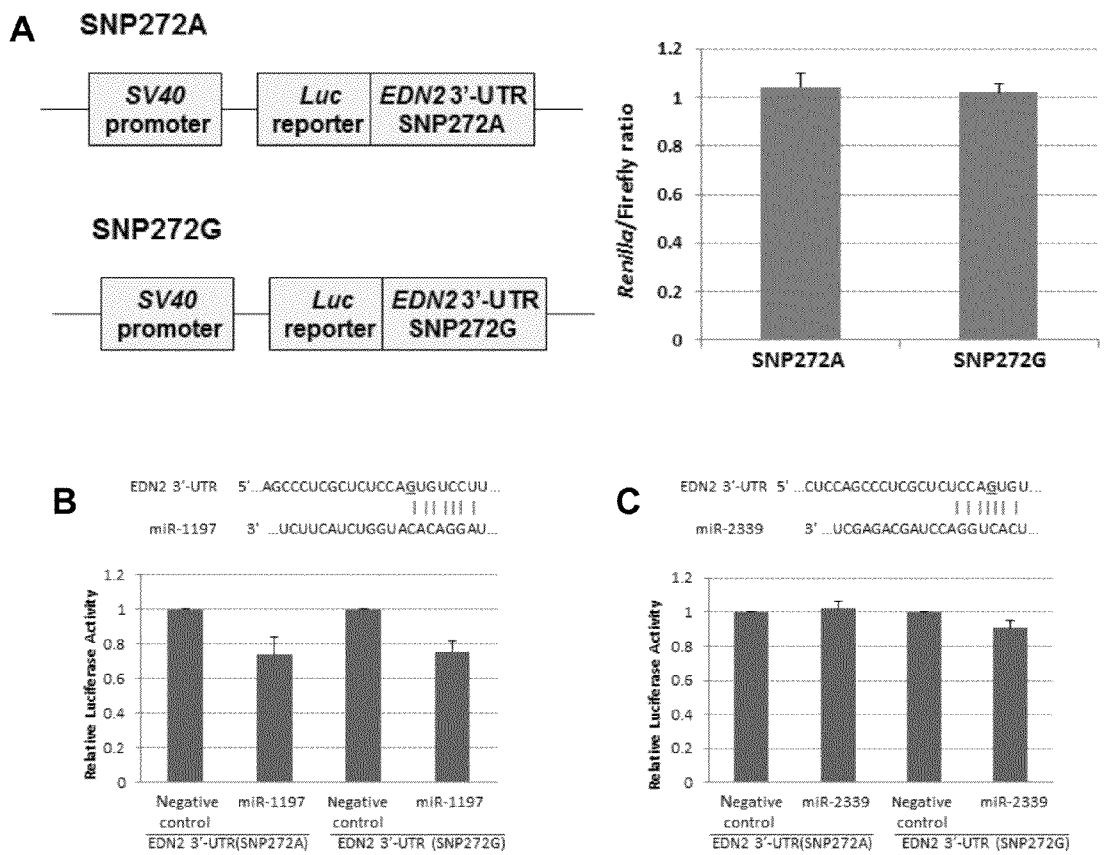
FIG. 22A shows the SNP272 effect on mRNA stability. Hek293 cells were transfected with EDN2-3'-UTR luciferase constructs (SNP272 A/G). Luciferase activities (in triplicates) were measured 24 hours post transfection. *Renilla* luciferase activities were normalized against firefly luciferase activities, and mean normalized *Renilla* luciferase activities (±SD) from three independent experiments were determined.
FIG. 22B shows that SNP272 is not responsible for bta-miR-1197's targeting of EDN2 3-UTR. miR-1197 and its predicted seed binding site in the 3'-UTR of EDN2 (top). SNP272 was highlighted.
FIG. 22C shows that the bta-miR-2339 does not target 3'-UTR of EDN2. miR-2339 and its predicted seed binding site in the 3'-UTR of EDN2 (top). Hek293 cells were co-transfected with EDN2-3'-UTR luciferase constructs (SNP272 A/G) and microRNA precursors (miR-1197 or miR-2339). miRNA negative control oligonucleotides were used as negative controls. Luciferase activities (in triplicates) were measured 24 hours after transfection. *Renilla* luciferase activities were normalized against firefly luciferase activities, and mean normalized *Renilla* luciferase activities (±SD) from three independent experiments were determined and expressed relative to control values.

SNP272. SNP272 in the 3'-UTR of EDN2 showed the strongest association in both Holstein and Jersey cattle. Due to the location and sequence surrounding SNP272, it was investigated for the possibility of affecting the stability of the mRNA of EDN2 using a luciferase reporter assay. When the allele-specific effect (A vs G) was compared from the luciferase constructs with AA or GG genotypes in transfected HEK293 cells, no significant change of luciferase activities was observed, indicating that these alleles of SNP272 did not affect the stability of EDN2 mRNA (FIG. 22 A). Binding of microRNA is another common mechanism by which the 3'-UTR regulates transcription. When the microRNA bta-miR-2339 was co-transfected into HEK293 cells with luciferase constructs containing 3'-UTR of EDN2, no significant decrease of reporter activities was observed, indicating that bta-miR-2339 does not affect the stability of EDN2 mRNAs (FIGS. 22 B and 22 C). The microRNA bta-miR-1197 exerted similar effects irrespective of the A or G allele of SNP272, indicating the microRNA effect of bta-miR-1197 is not mediated by SNP272.

Figures 23A, 23B:
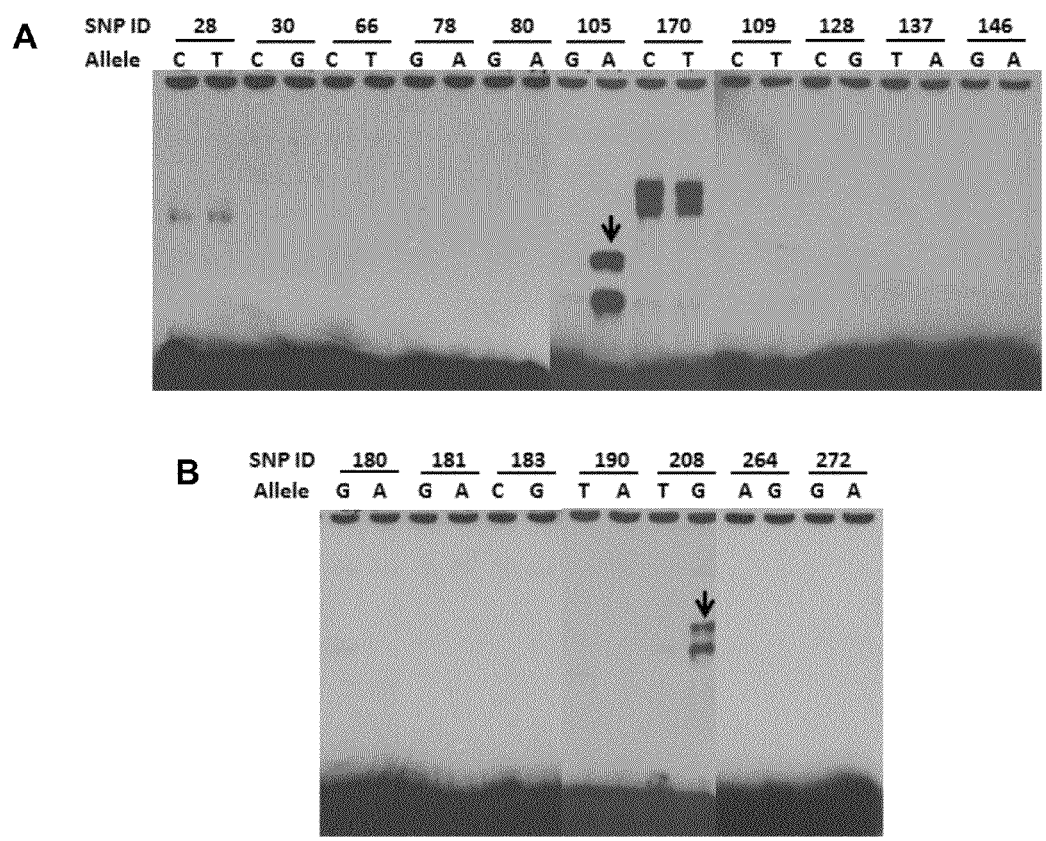
FIGS. 23A and 23B show EMSAs to screen for functional SNPS showing differential affinitiese to nuclear proteins between susceptible and non-susceptible alleles. Differential bands of SNP105 and SNP208 are indicated with arrows.
Figures 24A, 24B:
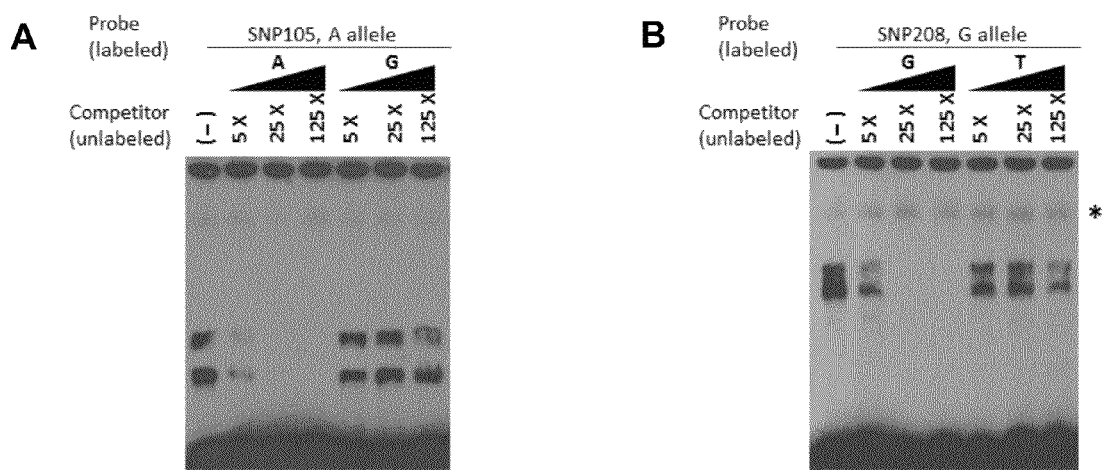
FIGS. 24A and 24B show EMSA competition assay for SNP105 and SNP208. DNA-protein complexes were competed away in a concentration-dependent manner by unlabeled oligonucleotide with A allele for SNP105 and with allele G for SNP208 (non-specific binding was indicated with star).

SNP105 and SNP208. SNPs located 5' or in the promoter region of EDN2 could alter expression of EDN2 or other genes through modification of transcription binding factors, enhancers or suppressors. To determine if these allelic variants had functional significance through nuclear proteins binding, electrophoretic mobility shift assays (EMSAs) were performed (SNPs and locations shown in Table 1). Most of the SNPs did not demonstrate differential binding between the two alleles with the exception of SNP105 and SNP208 which did exhibit differential binding affinities to the ileocecal lymph node nuclear proteins (FIGS. 23 A and 23 B). The binding of nuclear proteins was specific for SNP105 at the Map tissue infection susceptible allele (A), and for SNP208 at susceptible allele (T). The different binding affinity between alleles at SNP105 and at SNP208 was confirmed by a competition assay (FIGS. 24 A and 24 B). This is consistent with results in the TFSEARCH database which identified a consensus binding sequence of runt-related transcription factor 2 (RUNX2) with the susceptible allele that would be abolished with the non-susceptible allele.

Figure 5:
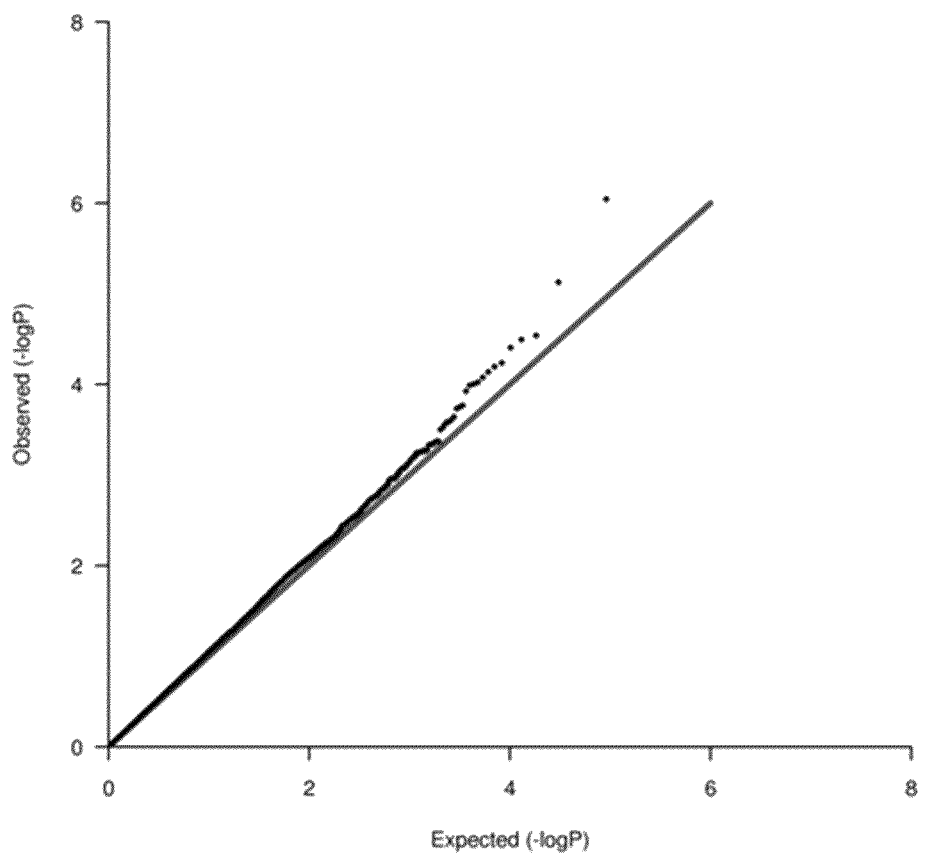
FIG. 5 shows a Q-Q plot for p-values from a 1-df test for association (allelic) versus expected for an association of loci with the Map tissue infected, fecal positive (clinical) cases versus controls. The Q-Q plot shows evidence of a deviation from the expected null distribution of p-values and therefore evidence of population substructure.
Figure 6:
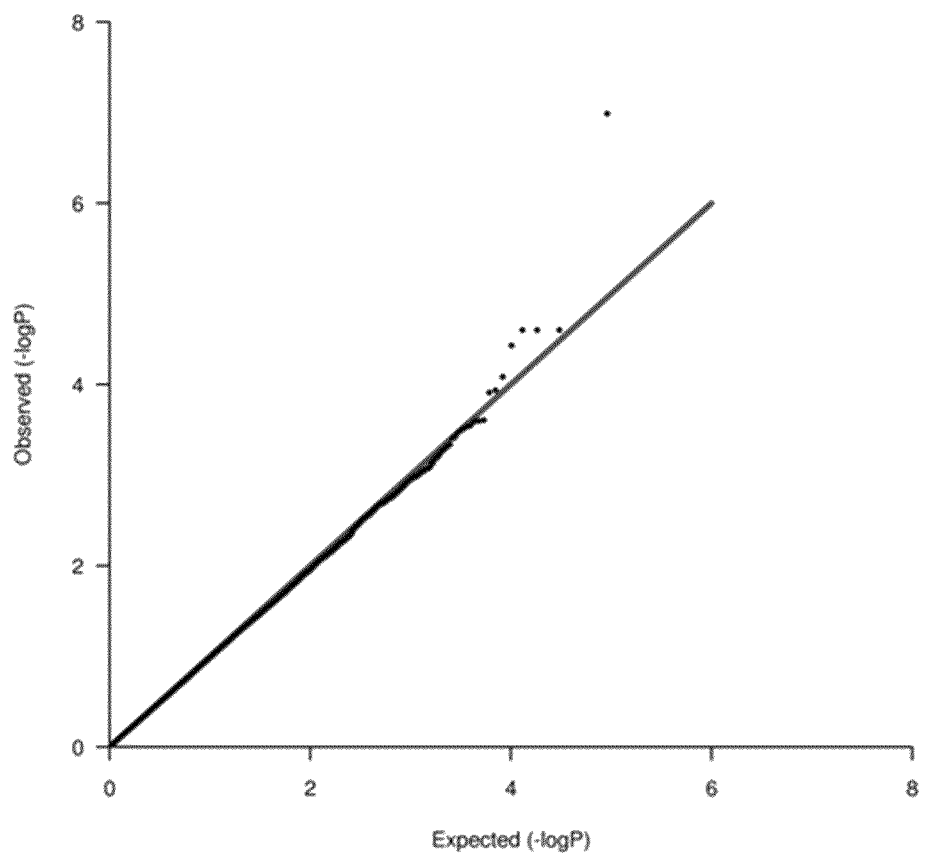
FIG. 6 shows a Q-Q plot for the stratified test of association (2×2×4 CMH test) within herd versus expected for an association of loci with the Map tissue infected, fecal positive (clinical) cases versus controls. The Q-Q plot shows little to no evidence of a deviation from the expected null distribution of p-values and therefore no evidence of population substructure.
Figures 25A, 25B:
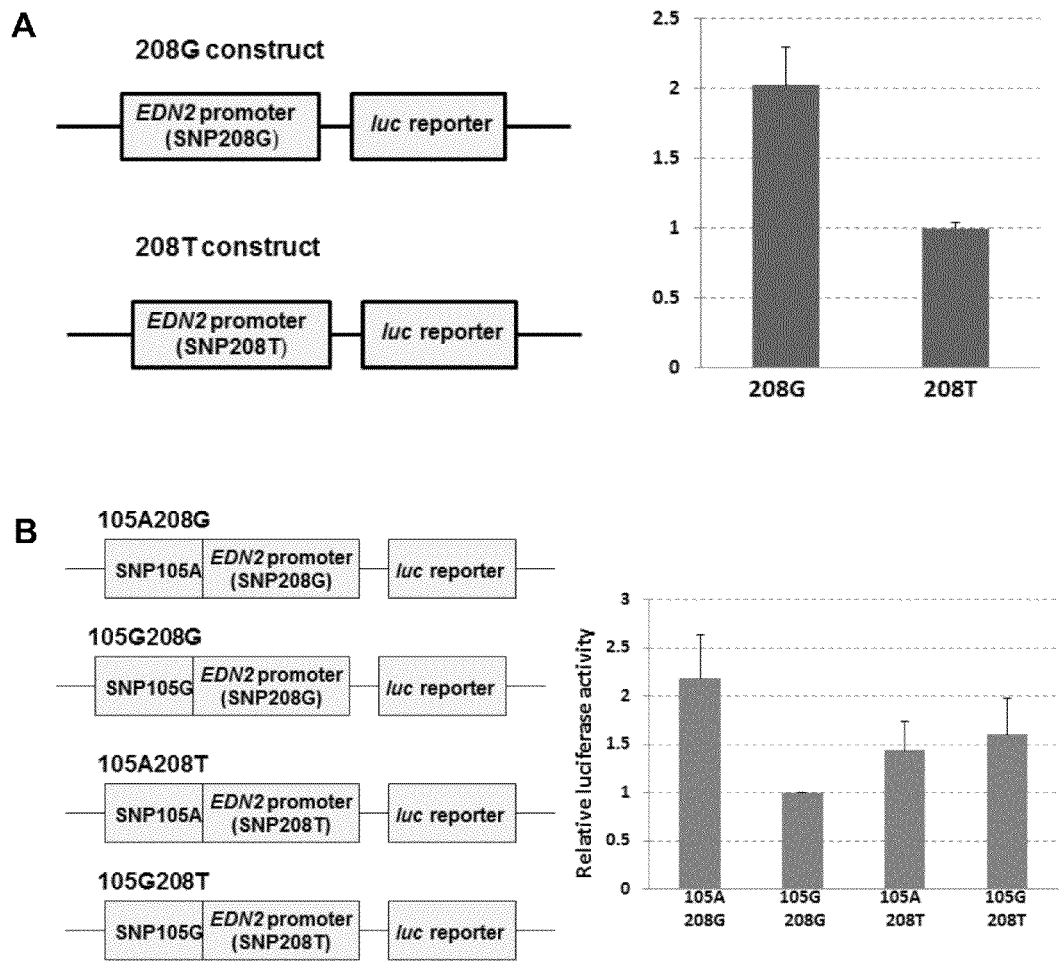
FIG. 25A shows SNP208 Luciferase reporter assay. HEK293 cells were transfected with EDN2 promoter-pGL3 reporter constructs containing either G or T at the location of SNP208. The relative luciferase activities were calculated and expressed as mean±SD. The relative luciferase activity of the genotype G at SNP208 was significantly higher compared with that of the genotype T.
FIG. 25B shows SNP105 and SNP208 interation. HEK293 cells were transfected with EDN2 promoter-pGL3 reporter constructs containing different combination of SNP105(A/G) and SNP208(G/T). The relative luciferase activities were calculated and normalized to construct 105G/208G. The mean of relative luciferase activity (±SD) from three independent experiments was shown.

SNP208 is located at the core promoter region of EDN2, 671 bases upstream of the transcriptional start site. To examine whether SNP208 could regulate gene expression, we cloned ~0.8 kb of the promoter sequence from individual homozygous for either G or T at SNP208, and used this to drive the luciferase expression in HEK293 cells. The EDN2 promoter with the non-susceptible allele G at SNP208 showed significantly higher luciferase activity compared with that with the susceptible allele T (FIG. 25 A). For assessment of SNP105, which is 11 kb upstream of the transcriptional start site of EDN2, a 31 bp oligonucleotide that was examined in the EMSA was cloned into pGL3 vector with SV40 promoter to evaluate a difference in its enhancer or silencer activities between the alleles. The 31 bp DNA sequence with the susceptible allele A at SNP105 significantly enhanced ($P<0.05$) the activity of SV40 minimal promoter. When the 3 lbp enhancer sequence was inserted into the 0.8 kb of the EDN2 promoter which drives the luciferase expression, allele A at SNP105 and allele G at SNP208 worked together to increase the luciferase activity significantly, indicating SNP105 and SNP208 synergistically regulate the activity of gene expression which may include EDN2 (FIG. 5 B).

In summary. Numerous studies have been carried out to identify the genetic variation involved in susceptibility to Johne's disease. Various approaches have been applied to identify genes and chromosomal regions associated with Map infection, including SNP polymorphisms in candidate genes and linkage analysis with low-density markers. Recently, several genome-wide association analyses using commercial high-density SNP chips detected multiple genomic regions associated with susceptibility to Map infection (Gonda et al. 2007; Settles et al. 2009; Minozzi et al. 2010; Pant et al.; 2010; Kirkpatrick et al. 2011; Minozzi et al. 2012). Although the presence of genetic variation in the trait of interest has been observed, the identification of genes contributing to the genetic variance (causative genes) was absent. Applicants initial genome-wide association study and subsequent fine-mapping study revealed a region of 10.6 kb on BTA3 associated with Map infection. The current re-sequencing and fine-mapping identified more than a dozen significant SNPs in both Holstein and Jersey breeds. Out of 18 SNPs tested in the EMSA analysis, two SNPs (SNP208 and SNP105) were shown to regulate the expression of the reporter gene when the genomic sequence between HIVEP3 and EDN2 was tested. Precisely how SNPs 208 and 105 regulate EDN2 or HIVEP3 is under further investigation.

In infected animals, Map bacteria commonly enter the body via the fecal-oral route, move across the intestinal epithelium, then use complement-associated and non-complement-associated receptors to gain entry to host phagocytic cells (Souza et al. 2007, Woo et al. 2006), where it is able to persist by inhibiting phagosome-lysosome function (Kuehnel et al. 2001; Woo et al. 2007). EDN2 has been found to be highly expressed in the gastrointestinal tract of the mouse. TaKizawa et al. (2005) found that, in intestinal epithelial cells, EDN2 could be secreted into the lamina propria and the dome region in Peyer's patch and that it might modulate immune cells for mucosal defense. EDN2 has also been recognized as a chemotactic for neutrophils (Elferink and de Koster 1996) and macrophages (Grimshaw et al. 2002). In addition, expression of EDN2 was increased in tumor cells or under stress, and EDN2 acted as a cell survival factor with a potential role in tumor invasion (Ling et al. 2013). Recently, EDN2 in intestinal villi was reported to function as an intestinal contractor in the maintenance of the intestinal architecture (Bianchi et al. 2012). The specific effects of EDN2 on macrophage function, intestinal structure and cell survival may influence Map infection through the transcription binding factors identified in SNPs 105 and 208.

REFERENCES CITED FOR THE ABOVE EXAMPLE 4, AND INCORPORATED BY REFERENCE HEREIN IN THEIR ENTIRETY

Barrett J C, Fry B, Maller J, Daly M J. 2005 Haploview: analysis and visualization of LD and haplotype maps. Bioinformatics. 21:263-5.
2. Cetinkaya B, Erdogan H M, Morgan K L. 1997. Relationships between the presence of Johne's disease and farm and management factors in dairy cattle in England. Preventive Veterinary Medicine 32: 253-66.
3. Collins M T, Wells S J, Petrini K R, Collins J E, Schultz R D, Whitlock R H. 2005. Evaluation of five antibody detection tests for diagnosis of bovine *paratuberculosis*. Clinical and Diagnostic Laboratory Immunology 12:685-92.
4. Elferink J G, de Koster B M 1996. The effect of endothelin-2 (ET-2) on migration and changes in cytosolic free calcium of neutrophils. Naunyn Schmiedebergs Arch Pharmacol 353:130-135.
5. Gonda M G, Chang Y M, Shook G E, Collins M T, Kirkpatrick B W. 2007. Effect of *Mycobacterium paratuberculosis* infection on production, reproduction and health traits in US Holsteins. Preventive Veterinary Medicine 80:103-19.
6. Gonda M G, Chang Y M, Shook G E, Collins M T, Kirkpatrick B W. 2006. Genetic variation of *Mycobacterium avium* ssp *paratuberculosis* infection in US Holsteins. Journal of Dairy Science 89:1804-12.
7. Gonda M G, Kirkpatrick B W, Shook G E, Collins M T. 2007. Identification of a QTL on BTA20 affecting susceptibility to *Mycobacterium avium* ssp. *paratuberculosis* infection in US Holsteins. Anim. Genet. 38:389-396.
8. Grimshaw M J, Wilson J L, Balkwill F R. 2002. Endothelin-2 is a macrophage chemoattractant: implications for macrophage distribution in tumors. Eur J Immunol 32: 2393-2400.
9. Jakobsen M B, Alban L, Nielsen S S. 2000. A cross-sectional study of *paratuberculosis* in 1155 Danish dairy cows. Preventive Veterinary Medicine 46:15-27.
10. Kirkpatrick B W, Shi X, Shook G E, Collins M T. 2010. Whole-Genome association analysis of susceptibility to *paratuberculosis* in holstein cattle. Anim Genet. 42:149-160.
11. Kirkpatrick, B W, Shi X, Shook G E, Collins M T. 2011. Whole-genome association analysis of susceptibility to *paratuberculosis* in Holstein cattle. Anim. Genet. 42:149-160.
12. Koets A P, Adugna G, Janss L L G, van Weering H J, Kalis C H J, Wentink G H, Rutten V P M G, Schukken Y H. 2000. Genetic variation of susceptibility to *Mycobacterium avium* subspecies *paratuberculosis* infection in dairy cattle. Journal of Dairy Science 83: 2702-8.
13. Kuehnel M P, et al. 2001. Characterization of the intracellular survival of *Mycobacterium avium* ssp. *paratuberculosis*: phagosomal pH and fusogenicity in J774 macrophages compared with other mycobacteria. Cell. Microbiol. 3:551-566.
14. Ling L, Maguire J J, Davenport A P. 2013. Endothelin-2, the forgotten isoform: emerging role in the cardiovascular system, ovarian development, immunology and cancer. Br J. Pharmacol. 168(2):283-95.
15. Liu Y, Qin X, Song X Z, Jiang H, Shen Y, Durbin K J, Lien S, Kent M P, Sodeland M, Ren Y, Zhang L., Sodergren E, Havlak P, Worley K C, Weinstock G M, Gibbs R A. 2009. *Bos taurus* genome assembly. BMC Genomics 10:180.
16. Lombard J E, Garry F B, McCluskey B J, Wagner B A. 2005. Risk of removal and effects on milk production associated with *paratuberculosis* status in dairy cows. Journal of the American Veterinary Medical Association 227: 1975-81.
17. Lu Z, Mitchell R M, Smith R L, Van Kessel J S, Chapagain P P, Schukken Y H, Grohn Y T. 2008. The importance of culling in Johne's disease control. Journal of Theoretical Biology 254, 135-46
18. Mikkelsen H, Jungersen G, Nielsen S S. 2009. Association between milk antibody and interferon-gamma responses in cattle from *Mycobacterium avium* subsp. *paratuberculosis* infected herds. Veterinary Immunology and Immunopathology 127, 235-41.
19. Minozzi G, Buggiotti L, Stella A, Strozzi F, Luini M, Williams J L. 2010. Genetic loci involved in antibody response to *Mycobacterium avium* ssp. *paratuberculosis* in cattle. PLoS ONE 5:e11117.
20. Minozzi G, Williams J L, Stella A, Strozzi F, Luini M, Settles M L, Taylor J F, Whitlock R H, Zanella R, Neibergs H L. 2012. Meta-analysis of two genome-wide association studies of bovine *paratuberculosis*. PLoS One. 7(3): e32578
21. Mortensen H, Nielsen S S, Berg P. 2004. Genetic variation and heritability of the antibody response to *Mycobacterium avium* subsp. *paratuberculosis* in Danish Holstein cows. Journal of Dairy Science 87: 2108-13.
22. Mucha R, Bhide M R, Chakurkar E B, Novak M, Mikula I S. 2009. Toll-like receptors TLR1, TLR2 and TLR4 gene mutations and natural resistance to *Mycobacterium avium* subsp. *paratuberculosis* infection in cattle. Vet. Immunol. Immunopathol. 128:381-388.
23. Neibergs H L, Settles M L, Whitlock R H, Taylor J F. 2010. GSEA-SNP identifies genes associated with Johne's disease in cattle. Mamm Genome. 21:419-25
24. Nielsen S S, Bjerre H, Toft N. 2008 Colostrum and milk as risk factors for infection with *Mycobacterium avium* subspecies *paratuberculosis* in dairy cattle. Journal of Dairy Science 91:4610-5.
25. Nielsen S S, Toft N. 2007. Assessment of management-related risk factors for *paratuberculosis* in Danish dairy herds using Bayesian mixture models. Preventive Veterinary Medicine 81: 306-17.
26. Ott S L, Wells S J, Wagner B A. 1999. Herd-level economic losses associated with Johne's disease on US dairy operations. Preventive Veterinary Medicine 40: 179-92.
27. Pant S D, Verschoor C P, Schenkel F S, You Q, Kelton D F, Karrow N A. 2011. Bovine PGLYRP 1 polymorphisms and their association with resistance to *Mycobacterium avium* ssp. *paratuberculosis*. Anim. Genet. 42:354-360.
28. Pant S D, Verschoor C P, Skelding A M, Schenkel F S, You Q, Biggar G A, Kelton D F, Karrow N A. 2011 Bovine IFNGR2, IL12RB1, IL12RB2, and IL23R polymorphisms and MAP infection status. Mamm Genome. 22:583-8
29. Pinedo, P J, Buergelt C D, Donovan G A, Melendez P, Morel L, Wu R, Langaee T Y, Rae D O. 2009a. Candidate gene polymorphisms (BoIFNG, TLR4, SLC11A1) as risk factors for *paratuberculosis* infection in cattle. Prev. Vet. Med. 91:189-196.
30. Pinedo P J, Buergelt C D, Donovan G A, Melendez G, Morel L, Wu R, Langaee T Y, Rae D O. 2009b. Association between CARD15/NOD2 gene polymorphisms and *paratuberculosis* infection in cattle. Vet. Microbiol. 134: 346-352.
31. Purcell S, Neale B, Todd-Brown K, Thomas L, Ferreira M A, Bender D, Maller J, Sklar P, de Bakker P I, Daly M J, Sham P C. 2007. PLINK: A tool set for whole-genome association and population-based linkage analyses. Am. J. Hum. Genet. 81:559-575.
32. Settles M, Zanella R, McKay S D, Schnabel R D, Taylor J F, Whitlock R, Schukken Y, Van Kessel J S, Smith J M, Neibergs H. 2009. A whole genome association analysis identifies loci associated with *Mycobacterium avium* ssp. *paratuberculosis* infection status in US Holstein cattle. Anim. Genet. 40:655-662
33. Souza C D, Evanson O A, Sreevatsan S, Weiss D J. 2007. Cell membrane receptors on bovine mononuclear phagocytes involved in phagocytosis of *Mycobacterium avium* subsp *paratuberculosis*. Am. J. Vet. Res. 68:975-980.
34. Takizawa S, Uchide T, Adur J, Kozakai T, Kotake-Nara E, Quan J et al. 2005. Differential expression of endothelin-2 along the mouse intestinal tract. J Mol Endocrinol 35: 201-209.
35. van Hulzen K J, Schopen G C, van Arendonk J A, Nielen M, Koets A P, Schrooten C, Heuven H C. 2012. Genome-wide association study to identify chromosomal regions associated with antibody response to *Mycobacterium avium* subspecies *paratuberculosis* in milk of Dutch Holstein-Friesians. J Dairy Sci. 95:2740-8.
36. Verschoor C P, Pant S D, You Q, Schenkel F S, Kelton D F, Karrow N A. 2010 Polymorphisms in the gene encoding bovine interleukin-10 receptor alpha are associated with *Mycobacterium avium* ssp. *paratuberculosis* infection status. BMC Genet. 11:23-31
37. Whitlock R H, Rosenberger A E, Sweeney R W, Spencer P A. 1996. Distribution of *M. paratuberculosis* in tissues of cattle from herds infected with Johnes disease. In: Proceedings of the Fifth International Colloquium on *Paratuberculosis*, 29 Sep.-4 Oct. 1996 (Ed. by R. J. Chiodini, M. E. Hines & M. T. Collins), pp. 168-74. International Association for *Paratuberculosis*, Rehoboth, Mass.
38. Whittington R J, Windsor P A. 2009. In utero infection of cattle with *Mycobacterium avium* subsp. *paratuberculosis*: a critical review and meta-analysis. Veterinary Journal 179: 60-9
39. Woo S R, Heintz J A, Albrecht R, Barletta R G, Czuprynski C J. 2007. Life and death in bovine monocytes: the fate of *Mycobacterium avium* subsp. *paratuberculosis*. Microb. Pathog. 43:106-113.
40. Woo S R, Sotos J, Hart A P, Barletta R G, Czuprynski C J. 2006. Bovine monocytes and a macrophage cell line differ in their ability to phagocytose and support the intracellular survival of *Mycobacterium avium* subsp. *paratuberculosis*. Vet. Immunol. Immunopathol. 110:109-120
41. Zanella R, Whitlock R H, Neibergs H L. 2011. Short communication: refinement of genetic regions associated with *Mycobacterium avium* subspecies *paratuberculosis* tissue infection and tolerance to Johne's disease. J Dairy Sci. 94:4230-6.

Nucleic acid sequences encoding mutant nucleic acid and proteins corresponding to HIVEP3 (Human immunodeficiency virus type I enhancer-binding protein 3) (SEQ ID NO:2); EDN2 (Endothelin 2) (SEQ ID NO:3); and LOC521287 (*Bos taurus* similar to forkhead box O6) (SEQ ID NO:4), and the respective coding transcripts (SEQ ID NOS:5, 6 and 7, respectively), and polypeptides (SEQ ID NOS:8, 9 and 10, respectively) are provided Nucleic acid sequences comprising one or more nucleotide deletions, insertions or substitutions relative to the wild type nucleic acid sequences are another embodiment of the invention, as are fragments of such mutant nucleic acid molecules. Such mutant nucleic acid sequences (e.g., mutants of genes: HIVEP3 (Human immunodeficiency virus type I enhancer-binding protein 3) (SEQ ID NO:2); EDN2 (Endothelin 2) (SEQ ID NO:3); and LOC521287 (*Bos taurus* similar to forkhead box O6) (SEQ ID NO:4), and the respective coding transcripts (SEQ ID NOS:5, 6 and 7, respectively), and polypeptides (SEQ ID NOS:8, 9 and 10, respectively) can be generated and/or identified using various known methods, as described further below. Again, such nucleic acid molecules are provided both in endogenous form and in isolated form. In one embodiment, the mutation(s) result in one or more changes (deletions, insertions and/or substitutions) in the amino acid sequence of the encoded protein (i.e. it is not a "silent mutation"). In another embodiment, the mutation(s) in the nucleic acid sequence result in a significantly modulated (up or down), reduced or completely abolished biological activity of the encoded protein relative to the wild type protein.

The nucleic acid molecules may, thus, comprise one or more mutations, such as:

(a) a "missense mutation", which is a change in the nucleic acid sequence that results in the substitution of an amino acid for another amino acid;

(b) a "nonsense mutation" or "STOP codon mutation", which is a change in the nucleic acid sequence that results in the introduction of a premature STOP codon and thus the termination of translation (resulting in a truncated protein); plant genes contain the translation stop codons "TGA" (UGA in RNA), "TAA" (UAA in RNA) and "TAG" (UAG in RNA); thus any nucleotide substitution, insertion, deletion which results in one of these codons to be in the mature mRNA being translated (in the reading frame) will terminate translation.

(c) an "insertion mutation" of one or more amino acids, due to one or more codons having been added in the coding sequence of the nucleic acid;

(d) a "deletion mutation" of one or more amino acids, due to one or more codons having been deleted in the coding sequence of the nucleic acid;

(e) a "frameshift mutation", resulting in the nucleic acid sequence being translated in a different frame downstream of the mutation. A frameshift mutation can have various causes, such as the insertion, deletion or duplication of one or more nucleotides.

It is understood that mutations in certain parts of the protein are more likely to result in a reduced function of the mutant HIVEP3, EDN2, or LOC521287 proteins, such as mutations leading to truncated proteins, whereby significant portions of the functional domains are lacking.

Thus in one embodiment, nucleic acid sequences comprising one or more of any of the types of mutations described above are provided. In another embodiment, sequences comprising one or more stop codon (nonsense) mutations, one or more missense mutations and/or one or more frameshift mutations are provided. Any of the above mutant nucleic acid sequences are provided per se (e.g., in isolated form).

Polypeptide and Nucleic Acid Variants:

Variants of HIVEP3, EDN2, or LOC521287 proteins have utility for aspects of the present invention. Variants can be naturally or non-naturally occurring. Naturally occurring variants (e.g., polymorphisms) are found in various species and comprise amino acid sequences which are substantially identical to the amino acid sequence shown in SEQ ID NOS: 8, 9 and 10. Species homologs of the protein can be obtained using subgenomic polynucleotides of the invention, as described below, to make suitable probes or primers for screening cDNA expression libraries from other species, such as human, mice, monkeys, yeast, or bacteria, identifying cDNAs which encode homologs of the protein, and expressing the cDNAs as is known in the art. Orthologs are provided for herein.

Non-naturally occurring variants which retain (or lack) substantially the same biological activities as naturally occurring protein variants are also included here. Preferably, naturally or non-naturally occurring variants have amino acid sequences which are at least 85%, 90%, 95%, 96%, 97%, 98%, 99% or greater than 99% identical to the amino acid sequence shown in SEQ ID NOS:3 or 5. More preferably, the molecules are at least 98%, 99% or greater than 99% identical. Percent identity is determined using any method known in the art. A non-limiting example is the Smith-Waterman homology search algorithm using an affine gap search with a gap open penalty of 12 and a gap extension penalty of 1. The Smith-Waterman homology search algorithm is taught in Smith and Waterman, *Adv. Appl. Math.* 2:482-489, 1981.

As used herein, "amino acid residue" refers to an amino acid formed upon chemical digestion (hydrolysis) of a polypeptide at its peptide linkages. The amino acid residues described herein are generally in the "L" isomeric form. Residues in the "D" isomeric form can be substituted for any L-amino acid residue, as long as the desired functional property is retained by the polypeptide. NH2 refers to the free amino group present at the amino terminus of a polypeptide. COOH refers to the free carboxy group present at the carboxyl terminus of a polypeptide. In keeping with standard polypeptide nomenclature described in J. Biol. Chem., 243: 3552-59 (1969) and adopted at 37 C.F.R. §§1.821-1.822, abbreviations for amino acid residues are shown in Table 6:

TABLE 6

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | glutamic acid |
| Z | Glx | Glu and/or Gln |
| W | Trp | Tryptophan |
| R | Arg | Arginine |
| D | Asp | aspartic acid |
| N | Asn | Asparagines |
| B | Asx | Asn and/or Asp |
| C | Cys | Cysteine |
| X | Xaa | Unknown or other |

It should be noted that all amino acid residue sequences represented herein by a formula have a left to right orientation in the conventional direction of amino-terminus to carboxyl-terminus. In addition, the phrase "amino acid residue" is defined to include the amino acids listed in the Table of Correspondence and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues or to an amino-terminal group such as NH$_2$ or to a carboxyl-terminal group such as COOH.

Guidance in determining which amino acid residues can be substituted, inserted, or deleted without abolishing biological or immunological activity can be found using computer programs well known in the art, such as DNASTAR software. Preferably, amino acid changes in the protein variants disclosed herein are conservative amino acid changes, i.e., substitutions of similarly charged or uncharged amino acids. A conservative amino acid change involves substitution of one of a family of amino acids which are related in their side chains. Naturally occurring amino acids are generally divided into four families: acidic (aspartate, glutamate), basic (lysine, arginine, histidine), non-polar (alanine, valine, leucine, isoleucine, proline, phenylalanine, methionine, tryptophan), and uncharged polar (glycine, asparagine, glutamine, cystine, serine, threonine, tyrosine) amino acids. Phenylalanine, tryptophan, and tyrosine are sometimes classified jointly as aromatic amino acids. Preferably, amino acid changes in the HIVEP3, EDN2, or LOC521287 proteins polypeptide variants are conservative amino acid changes, i.e., substitutions of similarly charged or uncharged amino acids.

It is reasonable to expect that an isolated replacement of a leucine with an isoleucine or valine, an aspartate with a glutamate, a threonine with a serine, or a similar replacement of an amino acid with a structurally related amino acid will not have a major effect on the biological properties of the resulting variant. Properties and functions of HIVEP3, EDN2, or LOC521287 protein or polypeptide variants are of the same type as a protein comprising the amino acid sequence encoded by the complements of the respective nucleotide sequence shown above, although the properties and functions of variants can differ in degree.

Variants of the HIVEP3, EDN2, or LOC521287 proteins disclosed herein include glycosylated forms, aggregative conjugates with other molecules, and covalent conjugates with unrelated chemical moieties (e.g., pegylated molecules). Covalent variants can be prepared by linking functionalities to groups which are found in the amino acid chain or at the N- or C-terminal residue, as is known in the art. Variants also include allelic variants, species variants, and muteins. Truncations or deletions of regions which do or do not affect functional activity of the proteins are also variants. Covalent variants can be prepared by linking functionalities to groups which are found in the amino acid chain or at the N- or C-terminal residue, as is known in the art.

A subset of mutants, called muteins, is a group of polypeptides in which neutral amino acids, such as serines, are substituted for cysteine residues which do not participate in disulfide bonds. These mutants may be stable over a broader temperature range than native secreted proteins (see, e.g., Mark et al., U.S. Pat. No. 4,959,314).

It will be recognized in the art that some amino acid sequences of the HIVEP3, EDN2, or LOC521287 proteins of the invention can be varied without significant effect on the structure or function of the protein. If such differences in sequence are contemplated, it should be remembered that there are critical areas on the protein which determine activity. In general, it is possible to replace residues that form the tertiary structure, provided that residues performing a similar function are used. In other instances, the type of residue may be completely unimportant if the alteration occurs at a non-critical region of the protein. The replacement of amino acids can also change the selectivity of ligand binding to cell surface receptors (Ostade et al., *Nature* 361:266-268, 1993). Thus, the HIVEP3, EDN2, or LOC521287 proteins of the present invention may include one or more amino acid substitutions, deletions or additions, either from natural mutations or human manipulation.

Amino acids in the HIVEP3, EDN2, or LOC521287 proteins of the present invention that are essential for function can be identified by methods known in the art, such as site-directed mutagenesis or alanine-scanning mutagenesis (Cunningham and Wells, *Science* 244:1081-1085 (1989)). The latter procedure introduces single alanine mutations at every residue in the molecule. The resulting mutant molecules are then tested for biological activity such as binding to a natural or synthetic binding partner. Sites that are critical for ligand-receptor binding can also be determined by structural analysis such as crystallization, nuclear magnetic resonance or photoaffinity labeling (Smith et al., *J. Mol. Biol.* 224:899-904 (1992) and de Vos et al. *Science* 255:306-312 (1992)).

As indicated, changes in particular aspects are preferably of a minor nature, such as conservative amino acid substitutions that do not significantly affect the folding or activity of the protein. Of course, the number of amino acid substitutions a skilled artisan would make depends on many factors, including those described above. Other embodiments comprise non-conservative substitutions. Generally speaking, the number of substitutions for any given HIVEP3, EDN2, or LOC521287 proteins will not be more than 50, 40, 30, 25, 20, 15, 10, 5 or 3.

All of the compositions, articles, and methods described and claimed herein can be made and executed without undue experimentation in light of the present disclosure. While the invention has been described in terms of preferred embodiments, it will be apparent to those of skill in the art that variations may be applied without departing from the spirit and scope of the invention. All such variations and equivalents apparent to those skilled in the art, whether now existing or later developed, are deemed to be within the spirit and scope of the invention as defined by the appended claims.

All patents, patent applications, and publications mentioned in the specification are indicative of the levels of those of ordinary skill in the art to which the invention pertains. All patents, patent applications, and publications are herein incorporated by reference in their entirety for all purposes and to the same extent as if each individual publication was specifically and individually indicated to be incorporated by reference in its entirety for any and all purposes.

The invention illustratively described herein suitably may be practiced in the absence of any element(s) not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments and optional features, modification and variation of the concepts herein disclosed may be resorted to by those skilled in the art, and that such modifications and variations are considered to be within the scope of this invention as defined by the appended claims.

SEQUENCE LISTING (124 sequences)

SEQ ID NO: 1 - DNA, 255587 bp, Bos taurus
  unsure (10433)..(10484): unknown sequence
  misc_feature (10434)..(10483): n is a, c, g, or t
  unsure (23417)..(23468): unknown sequence
  misc_feature (23418)..(23467): n is a, c, g, or t
  unsure (47035)..(47086): unknown sequence
  misc_feature (47036)..(47085): n is a, c, g, or t
  misc_feature (101763)..(101812): n is a, c, g, or t
  misc_feature (107407)..(107456): n is a, c, g, or t
  unsure (158723)..(158774): unknown sequence
  misc_feature (158724)..(158773): n is a, c, g, or t
  unsure (165923)..(171676): unknown sequence
  misc_feature (165924)..(171675): n is a, c, g, or t
  misc_feature (173830)..(174024): n is a, c, g, or t
  unsure (196285)..(196336): unknown sequence
  misc_feature (196286)..(196335): n is a, c, g, or t
  unsure (199403)..(199454): unknown sequence
  misc_feature (199404)..(199453): n is a, c, g, or t
  unsure (205496)..(205735): unknown sequence
  misc_feature (205497)..(205734): n is a, c, g, or t
  unsure (210613)..(210664): unknown sequence
  misc_feature (210614)..(210663): n is a, c, g, or t
  unsure (234602)..(234939): unknown sequence
  misc_feature (234603)..(234938): n is a, c, g, or t
  unsure (247485)..(247536): unknown sequence
  misc_feature (247486)..(247535): n is a, c, g, or t
  unsure (250696)..(250879): unknown sequence
  misc_feature (250697)..(250878): n is a, c, g, or t
  unsure (254597)..(254648): unknown sequence
  misc_feature (254598)..(254647): n is a, c, g, or t
atggatcctgaacaaagtgtcaagggcaccaagaaggctgagggaagtccccggaagcggctgaccaaaggagaggccattcagaccagtgtctcatctagcgccccgtatcctggcagcagcacagccgccactcaagagggccccctccaagagctactagccccgcagcccttcccaggcccctcgtcggttcttagggaaggctctcaggagaaaactggtcagccacagaagccccccaagaggtcctccatcgaagcctcagtccacatctcccagcttccgcagcaccctctgacaccagcattcatgtcgcctggcaaacccgagcatctcctggagggatccacatggcagctggtcgacccaatgagacctggaccctcaggctcttttgtgacccctgggctccatcctcaaagccagctcctctcttcccatgcttccatcattcctcccgaggacctgcccggcatccccaaagtctttgtgtcccgtccctcccaggtctccttgaagcccacggaagaggcacacaagaaggagaggaaaccacagaagcccggcaagtacatatgtcaatactgcagccgcccctgtgccaagcccagtgtgctccagaaacacatccgctcacacacaggcgagaggccctacccctgcggcccctgtggcttctccttcaagaccaagagtaacctctacaagcacaggaagtcccatgctcaccgtatcaaagccggcctggcctcgggaatgggtggcgagatgtatcccccagggctggagatggagaggatccctggggaagaatttgaggagcccaccgagggagaaagcacagattcggaagaggagacgggcaccacttccacacaccccacagagctctccccgaggcccaaacacccactcctgtccagcagtttatacagctccgggagccagggttccagccacgaacgctgttccttgtcccagtccagctcggccccgtcgctcgaggacccagctccctttgcggaaccctcatccgaacaccccctgagccataaacctgaagacacccacacgataaagcagaagctggccctccgcttgagcgagaggaagaaggtgatcgacgagcaggcgttcctgagcccgggcagcaaaggcagcaccgaatctgggtatttctcacgctctgagagcgctgaacagcaggtcagccccccaaacaccaacgccaggtcctatgccgagatcatcttcggcaagtgtgggaggatcgggcagcggactgccatgctgacggccacttccacccagcccctcctgcccctgtccaccgaagacaagcccagcctggtacctctgtccgtgccccggacgcaggtgattgagcatatcaccaaactcatcaccatcaatgaggccgtggtggacaccagcgagatagacagcgtgaagcccaggaggagctcactgtcgcggcggagcagcatggagtcacccaaatccagcctctaccgggagccactgtcctcccatagtgagaaagcgaagcccgaacaatcactgctgagcctccagcgcccgcccagcaccaccccccctgtgcctctgctgagaagccactcaatgccttctgccacctgcaccctcagtaccccccaccacaccttccgaggcagctactccttcgacgaccacgtcgccgactcggaagccctgagccgcagcagtcaactgtttacctcccacccccggatgctcaagcgccagccggccatcgaactgcctttgggcggagagtacagttctgaggaggcagggcccagcagcaaagacgcagcctccaagcctgcagatgaaccggaacccagggaaagcgacctcaccaaaaagaccaagaagggtttgaaaacgaaaggggtgatctatgaatgtaacatatgtggtgctcggtacaagaaaagggacaactatgaggcccataaaaagtactactgctcagagcttcagttggcaaagccagtcaccgtgggtgctcatgtatcttcggaggccgagaagagccaggccgagcatgagccctggtcccagatgatgcattacaaactggggaccaccttggaactcactccactgaggaaaaggaggaaagagaagagccttggggatgaggaggagccgcccagctttgagtccaccaagagtcagttcggcagccctgggccttcagaggctgctcggaaccttcccttggagtccagcaagtcaccagcagagccgaataagtcagtgccctccctggagggatccgcaggcttccagccaaggactcctaagccagggtccagttcagaatcagggaaggagaggagaaccacgtccaaagaaatttctgtcatccagcacaccagctcctttgagaaatctgactctctggagcagcccggcagtttggaaggggaagacaagtctgcggcccccttctcatcacccccgcctgccccgcacggacgctcggcccactccctgcagcccaggttggtccgccagcccaatattcaggttcccgaaatcctggtgaccgaggagcccgaccggccagatacagagccggagccaccccctaaggagccagagaagacagaggagttccagtggccccagcgcagccagacacttgcccagctcccagctgaaaagctgccacccaagaagaaaagactgcgcctggcagagatggcccagtcatcgggggagtccagctttgagtcctccgtgcctctgtctcgcagcccgagccaggagagcagtgtctcactgagtgggtccagccgctctgcctcctttgagagagatgaccacggaaaagccgaagccaccgggccttcatcagacacacgctccaaacccttgggcacccacatgctgaccgtccccagccaccacccgcatgcccgtgagatgcggaggtcagcctcagaacagagccccaacatctcccactccacccatatgaccgagacacgcagcaaatcctttgactatggcagcttgtccttgacaggcccttcagcaccaactccagcagctccagtggcctcagcagccccaccagagagaagaaaatgctttttggtgagacaggcttctctgaccaggcctcctgaaaccgagccagaagccacccccaagggaagacaggagagtgaggaaccaaaaccctcatccagtaaatctttggccaaaggcgcattgctcccagtttcctctgcagccacctcacacagcgggcacccaggaggcaagagccaggtgcaagacagaccagcgctgggggccactccgccctacacagaagcactgcaggtgttcccccaccccatcgctcagctcccgttgcaggagaaaccctacctgcccccgcctgtctcccttttctccttccagcacctcctacagcatgagccaggacagtcttcagagttcttccccacccaggccatgtccagcctgctctccacaccttactccatgccgccccttcctccctccttatttcaagctcccccacttcctctccaacctactgttctacacccgggccaactccacctcccccagctcatgcctcacccagccaacatcccattccgacaacccccttcatttctccccatgccttaccctgcctcctcagcactttcttctgggtttttcctgcctctgcaatcgcagttcacccttcagctccccagtgaagtggaaagccacgtgccccagatcaaaactagcctggccacactggcaacaggaacccctggcctctcccccagcacagagtacagcagtgacatccagctgcccactgtggctcccccatccagctgctcagcacccacatcagcccctccactggccctgcctgcctgtccagacaccatggtgtctctagttgtgcccgtccgcatccagaccaacatgccatcctatgggagtgccatgtacaccactctctcccagatcttggttacccaatcccaaggcagctcagcaactgtggctcttcccaagttcgaagagccctcatgcaaagggacgtctgtgtgtgggacagatgcgtatgaggtcgggcccagactggctggagtaagtgaagaacagagcagaggtttcccgactccattcttgagagtgcctgtgacattacctgaaagaaaaggcacttccctggcatcagaaagtgtcttgagcctggaggggagttcatcaacagtgggaggaagcaaacgtgtcctttcaccagctggcagccttgaacttaccatggaaacccagcagcaaaaaagggtgaaggaagaggaggcatctaaggtggatgaaaaatttgaacttgtaaaaccatgtagcgtggtgcttagcagcaccgaggatagcaagagatcggagaagtcctacttgggcagtcagggccagggcaggagggaactagaaacactctccagcctgtcctcagatccatctgacccaaaggaaattcctccccttcctcagccctcattgccccatgtgacaacctcaggatcagaggctttgaaggaatatgcccaaccatctggtaaacctcaccgaagaggattactcccatcaagtgtgaagaaagaagattccaaggaacaagctgacctccctccactggcacctcccagctcacaatctctgtcagaaacatcccccagaccagccaagttgcaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccaggggtttccactaaagctgctttgtccctcctgaggtctaagcagaaggtgagcaaagagacatacaccatggccacagctccacatcctgagacaggaaggcttgtgccatccagctcccgcaagccccgcatgacagaggtgagttcagtcttgtttttcttctactccctgattgtaaaagcctttgctgagcttttaaagccacattctcctcaaggtccatttgcaaaacgagagccaactgagtggacagatttcctctctatcagctgtgactggccaccttatttattggatttctttgtcagtgtccctcaaatcattggactagatgcatttcaataaagtgaactttaaagtgacccactttcccattagcttctattgaaatatcaaagaaacaatcttatccaaaagactgagttcgtaaaccttgctgatgggaatgcctgcaacagtttgagaattttatgccactccaacatatatttcttccttacagtgttagtcttttcctgcttttcgtattctctgcatctactatttctgttctctggtgccacttgagattttctcagagagtctagagtttgacaaaaaagactcctgaaatattccttttttcttttatgtgagtagaagagcaaatagaccttaactgtagtatccctctttaccggtaggtgacagttccacagcttgactcatctttgctgatggtagtgcacaacgctggcaatgctcatgttttctcctccattgcctctgacctgaggctgcattaggaggcatgaaatcttgatctctgcaagttcaggaagattgacatttgataattccaagtttgtttcggactggtgacacctccatatcctggtgtcaccttgtcaggtgacaagggcagcgtaaggattcaagtcatgatgtgctatgctgacttgatatttgtggaataacagttggtcttattggttgagtagcctcactgtgccaggcattgttctgggcacttgaatccagttgatgttcatcactgcctgtgaggtagcagtaccatttccattctgtagatgaggaaactgagagtcagaaggtgagaggtccagagcacatggcaactatttggcaaacccagaatttggaccaagacctgtctgactccagagagtctattttcttctttcaattattcaaggaaagaagactgtaaaagtgactgcaaatttaaagatcttcattagtaagtctttagaacagatcctttgaccaaataaatccccctaaactaaatcctgattgcagataaatgaacaaactatgttcattaacttctgcatttgcatcctcttttactgagtgatgcttgtgcattgaatttctccttagctcgcctggatattctgcaccaaactgtttcccaaatttattctctaaatatccttgtcagtctactgctgctgctgctgctgctgctaagtcgcttcagttgtgtctgactctgtgcgaccccatagacagcagcccaacaggttcccccgtccctgggattctccaggcaagaatactggagtgggttgccatttccttctccaatgcatgaaagtgaaaagtgaaagtgaagttgctcagttgtgtccgactcttagcaaccccatggactgcagcctaccaggctcctccgtcggtgggactttccaggcaagaacactggagtgggttgtcattgccttctccgttgtcagtctacagacatccttaaatgagatttccactattgttatacacatcacgactgattttctctccagtgtctcttactggttgtggctactcctgagatgctgtggtaattatagtcatactgagaacttattgtgcacctattatgtaccaagtactatgcccaacatgacttttttcctcacaaccacattgataggtttctatatcatgatttgatggataaagagaccaaagcataaagaagtcaggtaacttgcacaaggtcccaaacatagtaaatggcctggattcaaaactagatctcactctaaagttcttttggatgatctgaactgcccctctgtttcaatgactgaacactgaaaggtggtttaagaaaaacaaagaattaatttggcttaactgggtttgacaacaagttgtttaaaatgctgctttcctaaaatgagctgcaactttttcctggaatatctcatttggttcacttggatcagctgataaagaatccgcctgcaatgcaggaaacctgggttcaatccctgggttgggaagatcccctggagaagggaatggcaacccactccagtattctggcctggagaattccatggacggtatagtccatggggtcgcaaagagtcagacacgactgaagactttcacttaaacacttaaacttagcgtgtttcctaccagaagctcaccagtctgatacattactgtaactgcatagcccactgcttgatgcctttctacaatcatccctctctctggtctctgcttgcattccagtgataggttgctcaccaccccttagtacaacccaacccatctttgggcagtgctttaagaaagttccctattatattgacctgacatttgtcatcccatagcttccattaactgttagtagctctgaaaaggccctttgggtgatatcaggatttcaaagctcttcctaaccatctttatacaggaatagaccacccagtcaggtttgagtttggtcacatacattttttttttttttcatatgtaaaccatggggaaacccaagcttatacaagagttcactttgcagccacatttcgttccccaagtttctccttcctttttcctccttggcaataattttgacaaccgcatgcactattgcaaagagattaagaacaagggcttcagtgccagattgcccaaatttgagttccccgatctcacttactaattgactttggatcagttacttaacctctctgtgccttggtttcctcattggtaagacagagataaaaagctgtaagatagaaaatacgtagctcataggaatgtggagataattatatgagttaaaatatgcaaggtgtgattagaacagtggttggcacactgacacttgataatcactatcttcagttactcacattattatctttaaaacttaaagtgtatccctggtcccctgctcgagtccaaccatgtttcctggtagagtgtctgctgccaccaacaccagcctcctccagcttggctctgacatcacagctatcagcctgagggaggcctcttggtcattccatggatggcccagatggtaggctgacatggaagtgaaaacagcatgctctgaaaacctttgagtattgcataaaatcatcgatcttttgctgaagcggcacaccataccttctcttggtttccactccccatctccaattcagaagagattgtcagtgagtcactgaatcactaaagctgatcctggaatgaatctttaagatggtctaatcttgactctgagcctcagagaggtgaattaatccacccaaggttggctcagtttgcagtggcctatgtgatgcaagaactcagattccttgatttccaatcagctacttttctgttcagccccttgtaggagcaggtgtggtggctgaagcagggatttctgtccttagattgtcgcagcaccaggggacacagttgctgctcctactggctataaacagggcagttcctcctgaccttaatgaaatggcatgaagcaggatgagaatatcactgccagcctcagcccccagcccagcatcactgctctctattaaaggtgcacccatccctgccaccatcagaggatctaggggacaggttatccacccagctcttaacaccaaggcctatagctcatgaagagaatgggttccctaaaatgcccacccccccagacacatgcccatcagtgggcagcacagcctctctgtgtccagctctggcagcagtcgggggtggggtcagggccttcaggagacctgctttatgctcctagaaatgcccttgacttgctgtgtggctttgacttcctgatgtataaaggagaattgggccagttaatcttcaaaggtgaagtcttcatttctgtatgcagcattcctctcacacaccttctctgaggttggcatgacccaggagaccaagatgaggacctgtccccagaagcccctagactagtgtgaaaaaagagaagaaacacagctctcgtgggaaggcctggtcttccctagagaaaggcctgggcagagtcctggttctgacttcacctctggggattcatttcccttcttctgtaaagtggggcaggtagcatcttgtctccgggtagagggagaatgaatgaagtgagccatggtgaagcgtgggcatcattccatgacggcgtgttaaccagcagtgattttgttgttcctgcggtgggccaggttcgcctcccttcgctggtttccccggaaggacagaaagagatagctagagtggagaaagaagaggagaagagagggaagccggaggaggacgctcccgcctccaagagaggggagccggcgaggatcaaaatcttcgaaggagggtaagaattatgtttggtttgcagtgtctgctctccacgcagtaagcgctcgtgcccgcccgcaggctgggggtggtgcctgccttctgtgttcagaacggtgatctgtgttcagaggtggtgagcatctcatctggcaaggctgtgtccacaggagccctgggctttccaccttccaggaagtgccatctttgtgggacttgctggccacctctgttaaggaacattggctccttggtgggggctgggggacaccaggtatatgctgggcactggaacagtctgggtcttcccccagcccctcttgcctcagatgctggctgggttcctagaccccacattggggttgatagtgaccctcccgggtcctatgcggactgccgtctacgttggtacatgttctgcagaagtcacctctgtcctgcctaagcagccacagtgacaggtctgaggtcccatgggctctgccaactgggatgcttacagggctgatggtgcactgcactcatcagctgtacatactggtctctgggtctcttcctggactggcctgatccaggacttgttgatttgtaaacatttagaggaacgcccctggtttttcaccttcggtgctttgtgtttgtcaacctaatgactgaaacagctcagaattctcagctgtggggctctcggggctcccagaaggctgcctgcttccaggcctgctctgtggaagtgtcatgcgagctgtgttctgtgtgaccacgtgcgtgctccctgggatgtgggtgtctgtacgcaggtcccgtggtgtctgtctcagggtcctgtgtctgtgtccccagtgtaatcaatgcagccctcttcctacccagtcctgagggatnnnnnnnnnnnnnnnnnnnnnnnnnnnnnnnnnnnnnnnnnnnnnnnnnnctccagcacttgcaagtgcccagttcacaagatcaaagtgggaggtgccaggttcctctggagcactgggagaggagacagtgcccagctcccgaggccactggtgggcatccttcggcactgaccaacagggtctcccaggagaaggggtgtttgaaaactgaacttggggacttgtgttgtcacagcaatagggaggggagtcagggatggcaagcatccttcagtggcaaggacacgtccccaaaggggagaaatatcttgcccagagttcccgtaacttctccattgagaaacactagaccagcgggttttcgaaacactgtctttccacctggggactggcgggtttcctcttctgctacttggttagagcgcccccgtgtgtctctgtgttcgcacatcatcggatcctccaaaggccatgtaacatttcaccccaggattggtggatcaggcacagccttctccctgcagcttcaaggaccatctgtggggtcccaggggtggctgaatgtcagctggtgtgaacaaaggggtctgcctctgccttgagaggcaacagtccccagactggagatctggttccctgaggcagttcccttgttctgagccccgaaagggcagctggaaggagcctttccccagcccagttagttaacagctccagcccctcctagagtgagaggtgaaggccacgtctgggtcctcttctcctctttctgcagtctggccaggggtccccactctaacccacccccaccattccatccaggtcatcacttagtcccacccactctgttcagaatctccctgtcttgccaggtccagcatccctgccccagagtggctctcccactaacctgttccactgggacagtctcctcacctctccagctctgcctcccatcggtaaaaggggtaattacatacttggtgggttgttgggggatcttgtgctgccctatgtaaagaccagctcagttcatggtgctaacaaatgggtattggagtacttttttcatttttgtgtccattgttttgatcccctccaggataatctcactctgtcgactgtgaggaacatcaccctcactctctccacttgtcacatttaatttcagcactttggtagggggaacggtaatgccaccagtcaggtcatcttctcccacagtcccgctgtcccatctgggcccctactgtacctactgtacctcccaccttcgcttctggtgacccctcaatatttatggttctttgggggctggtgtcaccctccaggagagtttgcaaatgtggacttgaaagtttagggttgtcacagaacttccaagtgctctgtaccagaagatagccagagccaggagggtcaactgtgatcctgctctcatggaggctggctcaggggtagcagaaggcctggagctgaaatgtggggacccctgggcccagagtagccagagagggcttcctggaggaggtgggctgggcctggagggtatatgagacccggacaggcagagaggaaaggtgagtcagacggcagtctgggtgtcctggtgactcatgcacctggtcagtcggactcgtttcctgtggccttgaacggtctccctagtcagtgttgtccgcttccttggctaaacttcatccctgcaccaaggacatgaaatctgaatctccagctaggaccttactcctgaactgtagaccattgcttctgatgcctcatgggcacctctgcctggaagactagggcacctcaaacttagtatgtgctgaccaggctctacaggtaccaccaacagcatctccttccatcttgggaaccagatccttaggctcaaaacagctctgtctcatctccattaacaaatcctgtcaactcaccctgtgaaaccacatccagaagctgcccatttctcccacgtcccagctcaatcctctgctgagtttcatctggatcgtcacagtctcctgctagaatctcctgcttccattttacccactatcatgtactcttaacccagcagccggagcaatcccgtttaacatcagcagaccctgtcactcccactctgcacccttcacagacctccagtagcctgcgtgttctagccccagatcctccctgacctctgcctgcccctctaccccttgcttctcctttttcttttaaataggtcttttaaaaatttttatttatgtatttattgactgagcttggtcgtcacatgagctttcgctggttacagcaagcaggggccacgctctagttgcagtacgtaggcttctccctgtggcagcctcttttgttacggctcacgggctcgagagtgcaggttcagtagttgtggtgcataggcttagttgcctcacagcacgtggagtcttcccagaccagggactgaacctgtgtcccctgcattggcaggttcctaccccttgcttcctgtgctccagccaaggatctctttgtctgacatgttgctaccttagggcctgtgcacttgctgcacgctctgccttgaacacttttttcagagtcccacaggtccctcacttccttcagtcaccttcagagaagccttaccagatcaccctcctctctgtatcctcctccagcatttcttatccagcttcccttccctgctttatttttccccagtcactagtttacttctgtttccccctccagaacatacaccctgtgagaggtcaggaattgtgctttattcattgtcatatccccagtgctgaaaatggtgactggcatgtaggcagcgctggtgaatgtttattaactgaaggaatctccctttacctccctgaactcagcagcccttagaatccatgagcagtggagactctgggtctcaggaaggaggaaggacagagagtcagggccaacccaccaacctgacgtcagacttggcctgggaaggtgaagttgggtggcttcggctatggggcaagcaccctggggctgggagccaaggttgtttgcttgctgacctgccctgcaagtgttacaggtaaaaaacgaaacatgattccaaaaagggctggctcatgggttaccagcttcctggccagtgcctgctctgaatagatcctttctgtcctgggggccagagaggagtggtcctgggcacccaactctggagacaggccgctgtccttcctgggtgagtccaggctatcagggccgtgtcttctttctgactcagtgccttgatccctcttgaatgctcaggcttctccctggagtatagatgtgcagctttgagtgtggccccttgggccaggagcgagaggtcctgcttctgtcacatgttcccacactggctttagttctctttctatttctcccaaaccctgttgttccatctctcctagggaagacctgggcttttgtggacacagaggagggtgggatattgcaaagcacaggtgcgatattcaatggcccagaccagggagatggcagtggagatgggggtggagctagaggacatctggtgaatcgaatacaaagggtagggatgagaagcttggagtggagaatgactgccacgtttctggctcaagggtatatgaagctgccatttacggagatgggcagggatgggaaggagagtgagaaagaggtttggggaaggaggggtcaaagcttggtggacagtgttcagtttgaggtgccagtcagacatccaagtgttcaggaaggcgtgtggcaattggatatctgagcctggccttcagaggacaggaaaggtacatttgagatatgtgtagatattcacatttttcagtgcatagatgctatttaggaggatgcaactggatggtggatcacttggggaaatggaaagaaaagaatagggcatccaggatggggccgggatatgccagaggagaggtagagatgaagctgcaagagtctgagaaggaaaagccaaaagaatagaagagacctggcagaatgagaaatcctggaagacaagggcagagggagttcaaggtcagctgtgctgagggccatttaaaggccaaggacagggaggccaggcaagtgtccgtgggatatggccacatgggggtcactggtgaccttgatgggagctctttggggagatggagttctaaaggtggcgcatgtaaacctgtcccaagagtctggttatggagggaaggagggaatcacaaggaagtgaggagcaggacccggacatatgtgtgtgaggctgagcaggcgatatttacatggagagatcctccctaggcttgtgctgctaggaatgattgacagtaggggtgggtgggggagggcttggcagatgatgatgctgggagagaaggggctgagtgcaggcagagtcctagaggaggtgcaaggtgtggggccaagcactgatgagaagggggtgcttctcctagagtaatggtgcggggtgaggggagacagatgctgacgcactgcaggcagaactgatggtttggatgggggaagcggggagggttctctcagcccccatccagacctcttcttgccgttcctagatacctacattctcaacaacagatctgtgaatggctgttctgtttctaggaaaccacttagattcttgggaaagttattcctttgtaaagattatcctccaaatagatatctcagatgtaaagccatctagttaggtcgactctccatgctggcctagcatcattctactgaacactcagaggacttcatagggaacactcactccaggcattagacaaaactgattatgtcactatgaaacccagtaaacactgtgaaacgacagtaaaaaaaaagaaagaaaagaaaagacatattgatcaaggggcagactgagtgtctgagtctgctgggcccggagtccccagggtcttgaggatggtcagggaagacctaaatgcatcctattaaaatttaaaggagaatccatttctcaagcggatttggcctctggttgctatggggtctaaggcagcaagaggctcagctgagggggtggggctgggaagtggagtccccaccccagtgtgcgatggccgccggcagctgcaatgagcactgggcatcccctgggcctggaccgcatctgcctgagtctccacctgcctcctccctgtcctgggggatccccttctctcctgtgggggaagcggcctcttagcaaacagtggcacacactctccctctttctttcagtttttatttttttatttattttttaaaatgtatttttattcgtgtatttatttgcctgtgccaggtcttagttgtggcatgcgagagcttccgtcgtggcatatgaactcttagttgcgatatgtgggatctcgttccgtgaccagggatcgaacccagaccccctgcactgggagggctgagtcttagccactgtgtttattttatctaaattttacatgcacagagttgaaaaagccaaacatctctataaattttgttatggaagacgatagtacccttctttcccctacattttctgccctgccccacccccaccccagaagcaataactttcatctcttctagctgattatcttggttgaccttcgtatctgtgaataatgtgcctgggttgctactcttgggcttttcagctttaggtgctagctagtgactcacgagcctttccccagtccacacgtgacccctcatcccccatcctctcatcagagtcgtaccatttatgcttcacagctatcttatatgatacttttgctttcctatacaacttttattttctctaggaataaaagttgtatgtgtgttaacttcatcagttttctatatgctgtgctgtgcttagtcgctcagtcatgtccaactttttgcaaatcccatgggctgtagcctgccaggctcctctgttcattctccaggcaagaatactggagtgggttgccatgcctttctccaggggatcttcccaacctggggatcaaacccaggtctcctgcattgcaggcagattcttcaccagctgagctaccaggggagccccagttgtctatatatttattgttaattcaacccccagattctcacttcacaactctcccctgaagacgttcagatgcatcgggtcctctgtaaatcatcttgcagacacagtccctccctgagggatcctgtggactccaggccacacgggctgctccctcagcctggaacacagctgctaccccagggctccctcactctcaccctagagattctcttgcctcctatgcttgattgcctcatagccgtacatcttcccttttcctggtttacttcctcattttcacagagaccatccttcagcatggccttcttgagaaagggcctgtgagaggtgagctttttcgatgctttgcatgagtgaatggattgaagtgtttttattatgttcctcagtcgactcaagtgtctaattctgggttggaagtcattttcctttagagttttgaaagtgttgcttcctcctcctcaagcttctgggttgttctcaagaattccagatccatcctgattcttgttctatcctctgtgactgtctgagggtcttctcttcctgcttagagtggcgacttctcaagcgtgggtctcggtgtggagcagttttcatcactcgctgatgctttcaatctggcaagtcagggacttctgctttaggaaactttcctgaatggtttccttgaggattttctctcctctggttttctctctcctctctgtggtactcctgttattcatgcgctgagtaagtcctggctcgttcctctaatttctatgcctctctgccagaatccccatctcttcgtatttttgctctcctttctggggacctctactttatcttccaaccattcgtgttttccatttctgctatcacatttttaattttccttgcatgttcctcttatattaatagtatcctattctttttttattgagaatatctttatttatgtacttctgttagttaaaatattctctattttttaagttgagtgatttttttaaatttttattggagtataattgatttacggtgttgtgttcgtttctgctgtccagcaaagtgaatcagttatgcgtatacatatatccactcttttttagagtcttttcccatctagggctttacagagtatggagaagagttccctgtgctatacagtaggtccctactagtcatctattttatatatagtcgtgtgcatgtgtcagtcccaagattccaatttatccctcctcccttttgccaccctggtagcaataagtttgttttctacatctgtggccttatttctgtagtgtaaataagttcatttgtaccaagtatcctattcttatttgactgattccaggcctctcggaggctattaatgtcagttgttttgtctttagtgttcttttccccttgatttctgtttccttcaggttcccctcacccttggctttgtttagcctcttctctcaggtatctgataacctctggtgtcttcgcatgttaagagcgggaggctcaaagatgcctgggcacctgagtgtgagagcaaggcttccccgagactaggctgttctactgcggaggctgcagtggcagagtcttgtgtctttcttcttggatgaagactccagcctcccacctgaaggtggcagggttcatttcccataatctgagagccacagaaaggaaaaaggtgggacgcagagcgaagggggatctcagcctccagtgatgctttcactccatcccttcatttgtttgcaattccccatcctgccatcacctggcctgaaccccctcagaggccttccatctcaccctttgcagagaataaacctccaggctttttcaggagtgatctggctgctggagttgaggaaggtgaggtctgactgcttctaacaggactttccactagttgtccttatcttggtcctccccgtatgcacctccagagtccttgaggggccctgtggcataagtggagtttattctcatataacctgctgtcaacttagattccattctgttgggtctgcaaagtcttgttcagccatccgtctctttccagcttccaaaactgcattgccagtaccctctcctgctcttcccttctttgtgtgtttattatgccgagagagagaagcaaggggaaaggaaatataaatactgtttccccaccatctttaataacaggcgactagtagggttgatttttagaatgttttaggcacagaactcattcttccaaatagctcttctgagaaggtcaccctgcagccttccctataggtccttggagcccctgtggcacttccttgaacttctgggctcagaggagaacaggggaaggtgttggtgttccataaagtctgggaagtctttgggcattggcctgagacagaatgggattctaggcccacctctggcaattactggctagtccctaaagtaggttctttagtgagaactaaatggtaagattctatgggctctttactgtggcatataggaagtgcttagcaaagggttctctgccttccttgcttccttcccccttcactgttctttccttccttccatcttcctttcctcccacctccttccctctccagcatgaccatgatcttccccaggctccagtggcctttctccccaggcactagagagctgctgaaggtgttagccaggctctgtctctaacagctgtatgtgaacagtatatcaagaaggtgagagttggagactaatctgtggacaatgaaaatgaaatcaaaaaagagaaatgacacttgggttgggcaggtggaaagtttgactctgggttgagcatgggtccacctgaatttcattatctgcaaatcataggaaattttgccttttccatctttgggcgttgtttgaaatgaggcctccttgtcggagggagggaggtaagtggggtgggtcccagagctggagactttgggcaaatcatcttttctctctggactgcagtctctccctcagtaattggaggatatgggaaagggcttgggtcttggagtccgggactgggagctgcatcctgactctgcctttactggtgctgaggccttgagtaggcctttgctctttgtgaacctggctttctcatctgtagcatgaatggtcactgtgcggcttgggtgaaccatctctggctctcatgatgtgcggggtctttccagctcttgagctccagagctgtttcagctctgcactcagtacttgaggaagatgttgttcggagacagtttacagagaggggtctgagtgaagggcctatgcaggctgctgcaagtccttgtctctccctcagagaagctgccttctctaaaggtcaggaaatctaagccgagctcatctgcagggtgcccctgcctgagcaggagactttggcagtgtgccccagcctgagataagatatctgttgggaagaatttcctctcagagcccagagttgggtgttgtgtactgctttgcctggacatacacaggtgaggagatgaggggggcaatagacatatcaaatctctagaacttgccagaaaaatgaggagcttagaaaatttaagacagagttggaccagaatctcttggaggaggggtccctgctgtggtctgtcccccacaagcatcagctgctccttgctgcccacagtggggaaggcccagcctcgggataccctccagaggccacatcctgcctcctgtgcccacccacctgagtatcttcaatcatgctcttcagtgcctccctggaagtggagatacctctccatgccactgtgaatcttaaatagaatcagaccattaaatagagtcagctgtccagggtctggcccaacccctcccactgcactgccagacagaggggatgagtggcaccttgcagtcccaccccctgagcagagccctgcatctcagttgagcagaacatggggacgagagcataacttcggcatcagccagacctgggttcaaattctggttctgccactgattagaaaatcatataacatctctatggctcaggtttctcatctgaaaaatgggaataataatagcacctgttgagcaaagctgagaattgaaggaaatgatgtttgtatatcatgtgcccagcatatgctggacctcttaatctgccatgaatgatcggtacttacttacatgacggcctcttccactgaggagtcagcgggtgtctctctcttccgcaagcactctgtggtagagtgagcgctgaggccagaccacctgcgtgggaaccctggctctaacatggcaaccagctgatcataagtgagttaggtaattgctctgtgcctcagcttcctcatctacaggatgaggacaataatagcaattatgtctcaaagagtccatatgaggcttaactaagaagccacatgtaaagccttggcagtgcttgatgtgtagtaagtacttaatcaaagtccactgttatcattattttgaaagggtccctagaaatcatttgatccaaattcctcaccttgccaatgaggaaaccacagcccagggaggcattaacacagcatagcaataatagaagccagcctcttggccttcactcagaacacgccaacaggaagaagggaggaaggctgtgtggttgagtgtgtatgagggcacaggatctgtgccatctcgctgcggccttgctgatggcagggaggtggcattgtggtgaattaggctgggattctgacgcactttcagctcccatgaaaagagacgtttgactccagaggatcccttgtgttcaagagctaacagggtggcctggttggggagacacaccctagcggtttaaggagggcctccccccgccatggggtggaccctacatggagagttagagcccgaccagacagagaggcctgacgtggccttggatagaaggagcataccctggagaattcagggctgatggttcatggtgttggcaatttgcacttaaacagttccggaaaaaaagaatttttttagaactatactttcaacatgtttgtgattgtttaaaaataaaaacttaaaaaagagaacgaactagtttggctcagaagaaaggagaccagggaagccaggaattgaggaaagagtttaaaagggcagaggctgtcaggggctgccgggcagagctccgaacaagcagaatcagccaaggccaagaaagggagctaaaggcatcagatcagacaaagagccgggcctgaactccaagcagaatgttggatctgtgtggtggatgggcgtcctctgtcaccataggtggcttgcaggccaaagaaggacagcccagctggtgggagctgggtcccggggcacagcagccagagaaggcagcctgggctggagcctgggtaccaggcggcgggcgtgctgggcaggcctgttcccaggaacatggtgacagcagacaggacggacacaggaggcaaaacaaacctaaggcagccagggaggagccaggctgtgagcgaggccttatgccccactggcaatgcagctggcagactggggccaggaggcggccagccaggggccaggccgggcttctgggaactggagccaggagcagacagggcgcttccccggggaaggctgcgaggagtagggacagccagcagggcagagggcggagaggctggtccgccggctgtgctgttcagctgggaggcaggacctttaggggcctgggagggcagtgtgttcacccagtccagttgagcccaggctgattcagaaagaagaggagccaacccctagcagagaggaagaaaccagttcccatcaactttctaaacatcagcagatggagcagtcgggctgtctctcggaagcatctgagactgcttagctcgggagcttgggcccagaccctacaaaccacgatttttctgagctttgtcacctcccagcgtctgccctctgttggttctgatttcaccaacgagtggtgaacccttcccgtgaggagggcagctgaagacgcatgtcctcctctcagtggtcaggggtcgggaaggaggaggggaggggctgagaggaggtggtggttggatgggtctggacctggggaacagagtgtccctgaggatccagccataggctgagcggtgacccaggagctccagctgaggctgaaggagccagcatgctgtggattcatacaggctgggccgtccctcacctggactccagcagggtgcccgtgaggtcttgttgctgcaggaaaaggcccagcagtgacccacggatatccccatgctggtccaggctctttcccttcccccttctaggggccagagtacctttagtcagccagcccttacctgaggggagaggctattgtgaatgcagtggggcctcacctggggtctggcaggacagggcatccatcatgcttgctcaaatcctcaccaaagaatcctaccccttcaccctcttccttgggtctcctctgcccggtgtgccaggaagggccatcccagcgcagacaacacactgaaagcagccagctgggctcctcaggtgttggaccgtctccctagtacaaccttgagactcctggatggcgtcaagcactgggttcctgcaggaagtagtaaggaggaggttggggttccagcaggctgtgcacacaggcctggccatgcaccatagggacccctctctacaccccacctgctgggtgggcctgggtgccatccctttcctctcgaggaatcagggtgctttcacccacaccacgctgggaaggttgcttccatcctcccaagaatccttcatgtgtcttgtcccctccctggactcttgggcccttggctnnnnnnnnnnnnnnnnnnnnnnnnnnnnnnnnnnnnnnnnnnnnnnnnnnacccaggagccaccctggctctaccccagtgagctggctgatctgggacgaaccgttagcccacctgtgcagctgctccttttctagggggtgactggaatagggcggcctcttggggttgaggtgaggcttaaatgagaaagcctcgatcgcatcgccccagcggcatggaaccagtgtgtctagagacggagtctggctcgcctggaaggacgctggtcaggcaggacagaggcaggaatggtggcggcggggagggatcaggagtgtggcctctggggccgggtccttctgcatcactgctgggtgtgtgacctggcacagtggctcagcccctcagtgccccctttctcatctgccgtgtgggaagagctctgctgacacaaccaagggctgttctgaggaccaaacacataaacgtggcagcttggtgagtcccacagctccgctcctggcacctcctggccggctttgcacacgcagctgttgaccaggaggctgggcggtacgtgggaagcacctctcagggtgcagcagtgagctgaggatgaggggcaggtagcaaaggcagagggtggaggagggaagatttttccagatggacaaactggcccaaggctagaggcttgtggtgctggcgaggctggagagggacaggagttgcagtgagtgggagatgagtaagccatggaggggcctgtgatggggtcatggggtcacaggtgtcagtgggggcggggaaggacctctgtcgcttttccattaaatggaaaaggccatattattcatccctttttaaaaaatgggaaagcataaatgaaaaaataactataaattttatagacactccatgcactggggctatttttaaatcccctgttattcctataactccattagacaattggccggaaagcctggctcagaaagaaccctgactggctccccagtcccctccagagcaccccgtgtttgattaggccccagaccacttccctaggtgccccagtccaagcttccagacatcccaggcttctctgcctctgctctttatcttgatgttccctccacctggaggaacctctcctcttctttagctccatatccccacagtggactgtcctcagagctcgagtcaaatggccctgttccatggagtctcccagacctttccccaccctgctgctgcctgccatacattgcctcttcttccgcagccccccagacccattgtctcaccttatcttgacttgcattattttctgtttggttcagacaaatgcatgttccccctcatggccagccttagagcccacaggcaggggaaatccttttcataaaatgcacttacagttcacaactgtaaactttaaaatgtaggcagtgggctgatgagaatgatctttggcatgctgtggtgccactcactagctttgtggctgagggcaggtctttgtgagtctctgggctcagtttctccgtctctggagcacagacagccatctctgcctcccaggctgttgtgaagccagaaggctggaggacacgtgcggtacctgcctccaatctcagcaaacactgaggagagctgtgggaaaccttagcaggctctgttctcatccagccgctctgagctgattctacatctcatctgggtgtcgttctgatcacagggttgccttcttgccgacggttgctctggaaggcacttcacgtggtgtgaacggcagatgtaagtgatgttccagggccagtgtgctagagagctgtcctcaggcctccaggagaggctgtgcactgactcagttctctactggtgcagggaggtgtggactcattgggatggagcagccctttctgaggaggtcacacccagtcccgtcagcaccagccccactttggagacgggagtctctggccaacatggtcctggctctgctgtcaatgttagtcactcagccatgtccagctctttgccaccccatggactgagtctgccaggttcctctgttcgtgggatttcccaggcaagaatactggagtggattgccatttccttctctgggggattttccaaacccagagatcgaacctctgtctcctgagtctccagcttggcaggcagattctttatcactgagccacctgggaagccctctgctgttaatgcctgtgtgaatttgaggggggacctcaggcaacttactgatctctggtgaccactgattgaaatgcagcacatggccccctggactgagccctgtccactccaacagtcccctcgccatcctgtccttcccttgcacccgcctaccctcccatcaacctctcccaccctctctgcaataatagcagccgtggcctattgaaggcttgctgtgccccaggtacagaactcagcactaaacccttcacaaatataatttctaattccatcaccccttgatgaatagtgtgtgtgtatgtatatatatatatatatatatatttatacacacacacacacacatacaaccattctccagatgagggggttgaggcccagagaggcgaaggaacttgaccatggtcacttgggtagtgaggaacagagctacaattcaaattcaaacctctgtggctccagatcctgggttcttcccttcacagccccctgccactaactggggaccctgctttctgcatcttctgattctcagtcacctgcatggcaaatcccagttgaatcctgttcctgcccctccacgtgcccctggccaggccctgagtggaccccactgagtgtttgtggatagagatgatggtgatggtgatggtgctgctggtgcggtgctgccccagggcccgtggtgaaggatggaattggcagggggaggtatcctctcccctctcataaagaagactctttggaggctgtctcagaagctgtaatcttttgagacttgcatccccagggtgagcagtggaatgaacagaagtgaggacaccagctccaaaaggtgagggctgcgcggggccgaggagagtggaacatgaggaaggcctcaaggagatggcccattgtgtgcttggggtgtaactcccagtccttgaaaaatgtcttcagggaggttcagaagcgtctacttcccctttacattagatgattccaaaagagccatgtccctggtggccagcacctcatgttcgttctctgggtttgctttttcacgtccagtgcctgatcatggccaggttcaccgaactggaggcagatgagatctgacaagttttcatagacatggcatttctgaaggataacagagctagtggtggcaacagtctgaactaaatgtatgagctctggaagctttcagcagccacatctctcaccctgcctccctctatgcagtgcccgtcccttctatcatgctaagaactctccaacgcattcaaagcttttaaccaaagagaagatgagatgtgatcagccagcaggagctcaagctgtccagggaccattcctgcttgtggatgtgccgtgaccccagccccatcctccagtggtgaggaccctcatttggctgcagcttcggtcagtcatttaaggtgacaggttgttgaaaggctacctgtaaacgtaaagctcacatggtccagtctgccaggcctccagggaagccttgttttctggttttcaagtgcaaaaactcaaatctctttattcttaaattcagaatttcttctaaatctgttcaccatcttgcacctctatcatcctgatataaatctgacggtttggttaacttcactgaggcttttattgaccctgcattttctttattgggtcttgatctttcatcacattgatttccatttcacattgatttcaaaactgtctcacatggactgctagagtatgtggtacaaactccctgtctggcggatcatgtgttgtaggaggaacaaatgctgccttcagccatgtattcagtatccaagtatggatgctggaatgcttcatgttccgagtcagcaattccatcttcatcactggaatttggtcctcaccatcatcctcttgcctatggtcgcagagggcttccaagggcttcagcatcctcatcagcatgttctgaattcctttgtaaatttgcctgtggctggggtggaggaggggatgatggagcttcagccctaccgcttcctgtatgagctggtcagtatatgccggggatggacattccactggcatcttagccccaaaccatggcttcccctttgagttgggagggaaggacatctctatgcttcacagtctatcaaaattggggacatttgttttccttacgttattttaatcttttgtccgtaccacacagcatgtgagatcttagttttctgaccagaggtcgaacccaggcccccttcattgacagcacagagtcttaagcactgcaccaccagggaagtccctcctcatattgttgaaaattaaacctaactgtgatgagcgctctcaacgcagagcgctagacagcagatcagatacagattgatccctgctatatgctaagcacagttcaaagcacataacctagactaacaaagttaacctcacaataaccccgtgagtatacatgttactttcaataatttaaaaaactgaaacagaccatacacacaaatggagaaggcaatggcacccactccagtgctcctgcctggaaaatcccatggatggaggcgcctggtgggctgcagtccatggggtcacaaagagtcggacacgactgagagacttcactttcacttttcgctttcatgcactgaagaaggaaatggcaacccactccagtgttcttgcctggagaatcccagggacgggggagcctggtgggctgccgtctatggggtcgcacagagtcggacacgactgaagcgacttagcagcagcaaacacacaaaagcaatccaagtcataaaagtacagtctatgagttatgacaaaatgatgtataattttgtataattatacaaattatgtccagttacccccaagtcaagaaacagtacaggatcctcattttacagatgaagcaactgaggcacagagaggttaagtaacctgcccaggatcacacagctaagggttcagccaagaggtataataataaagccataccacagccacagcgagctgctctgagtcgtcagccccaaccctgccacggggcaggaacatgctcagggccacacagctggtggcaatgaggcaggatttgaaccccagcagtctgaccctaccaaccccccaacccatgcctaaccactgcactctgcagcatcccaaacaaagcaagtggatcccaacttcaccacactgtagctgtgcaacctcagacaggtcctttcaccctccgagccatgaccacatccttccttcctgttttctcaccttatccccctgcgggctgtttgaggctggaactccaggttggatactggccatttagattccaactaggcccacctcaaatccagcctctctaccataggaatctattttgctcaaaacctgacttttagtctgtgcttacactatccatgctggggggctcactaccacccaagcttgctttgctccaagtttgtagctctggggttggaatattctattttaaaatgaacccagtccttcctacctgtcttggttttgcctgtggactgaaccacctcccaggagactgcattaattgtacttgtgacccgaggaatttgtggacaaatttctatgagcctggtttctcctctactcccagctggtagagagcagatctgctcagaacaagagccaagaaggtgcctgccatcatgggacaactagaatggaactctcttctcttcccctgtaagatttgagtctgtaagtctggggcccaaatacacagcccccttgtgtgctctgcaggttgaagcagctggtaatgccagctggccccttcttgaaaaggggtctgatgcgttgcagtagctatcctgctgccttcaaatatttgggaaagccttgctgtcattcagttcagttcagttcagttcagtctctcagtcatgtccaactcttttcaaccccatgaatcacagcacaccaggcctccctgtccatcaccaactcctggagttcactcaaactcatgtccatcgagtcagtgatgccatccagccatctcatcctctgtcgaccccttctcctcctgcccccaatccctcccaacatcagagtcttttccaatgagtcaactcttcgtatgaggtagccaaagtattggagtttcagcctcagcatcagtccttccaaagaacacccaggacagatctccttcagcatggactggttggatctccttgcagtccaagggactctcaagagtcttctccaacaccacagttcaaaagcatcaattcttcggtgctcagctttcttcacagtccaactctcacatccatacatgagtactggaaaaaccatagctttgactagatggacctttgttggcaaagtaatgtctctgcttttgaatatactatctaggttggtcataactttccttccaaagagtaagtgtcttttaatttcatggctgcaatcagcatccgcagtgattttggagccccccaaaataaagtctgacatgtttccactgtttccccatctatttgccatgaagtgatgggaccagatgccatgatcttagttttctgaatgctgagctttaagccaactttttcactctcctctttcactttcatcaagaggctttttagttccttttcactttctgccataagggtagtgtcatctgtgtatctgaagttattgctatttctcctggcaatattgattccagcttgtgcttcttccagcccaatgtttctcatgatgtactgtgcatcatgggatgcagggtatacccttaaataagcagggtgacaatatacagccttgacatactccttttcctatttggaaccagtctgttgttccatgtccagttctaactgttgcttcctgacctgcatacaggtttctcaagatgcaggtcaggtgctctggtattcccatctctttcagaattttccacagtttattgtgatccacacagtcaaaggctttggcatagtcaataaagcagaaatagatgtttttctggaactctcttgctttttccatgatccagcagatgttggcaatttgctgtcattgcctcacagctattccccagcatagagacacctgacattcattgtgggaatctgatgtagttcacagccttttcttatttgcatcttgaggcatacgaatctctgagcattgaggaaaccctgaggttccccagagcatggtggcatggcgcctcatagccattggcctgtaggcattgatcaggcacccaatgtctacacatatttcatcagctgctatcacagatggccttggtcaggctcccctcaactcgcccttgcatgccagcctcagggggtgcttccagagcacggctgtaagagaacactgtcaccatcccctctgacacaggccaggcttctgtaccagcccctgaggtttgtctaagccagcttccatccctgcttcttgccatatagaattgccgtatagaatcatgccaaggcttgattataattcctataatacatgcctaacactccacaaatgctagctgtttctttttccctaacaaaaaaaaacacctctgatcctggctgacgttctttttgtgctttttagtaaagagtaaaacatgcgtccagtctccaggatctggtcacttccccattcttgacctgtttcctgtctggggaacaaggaagtgaagctgggagaaccagccaaccatagtcctgcatcaggctggactggctccagtcacaacagggggcctctgggtgctctgggccatcccatcttaagagggacaacctggaggggttgggaaggtctggggaggaatctggaatccatcttgagcacatctgtttgaggcctggagcagaggaatcttggctagagcagcatcctttagggaccctcatgtgcaagagggcttgcactgaactgtgctcagactacagaaggtcaactttagcttagttaaggggagctctgcccagagtggaaggtgctgcctgggacaccatgagaccccaggtgccagaggtggacgcgcccaaggaggggtgtggatgggctgccctaagaatgacctcatcagagggtgcacgaggcccctcccacccaggaagttgaaggtttttaggtccttcccagcatgaatgtgctttaacagtgattttcaaattgattttaaattcacagaactcttttttacaaatagattcctattctgaaaaacagctcaatgcaatgagggacatggggacccagaaccctgctgctcagcctccccttccataaatcctgagcacagcgtgaaaggccctgcaagtcagggcctgctaaaggctggggcacccccatgtaaatgggcacctttaagaagtgcaccccttgttggtagtttcacttctctgaacacaacaggcccagtttctggcatcctgcctccctccctaatgtcactgtctggtcggaaacagggccttggctgcattctttgggcctgagctggtttcagcccaggctgggtgcctgctcggtggttcttaggcttctgcactcagtcattcattgcacagtgtctcaagtcatcgtattgattcctttagaataaaagccacctcctctttttagacctgagtgctgtgtgtcagacccctgagctgctgtcttcagggcagctgatgctgtttactgttgtccccctagaatgacaaatcacaccagaaaaattgagaaaacagcccaaatggcacagatgcaagcctgcaaaatagacacgggctggcctccgtggtgggagtgcttctgaaaagtgtaaagcaggcttcttgacctgcctcccctcctgtctctgtcaggcagcctcgactcctggaatctgtgtcctctttcctctcgcccttgcctctgccccatcttgggctccatacaattacaccaccatcccccagcttccgggcctcccagcccactccatccccaaccctgcaccagatggggactcccaaaacaggagtctccccagtcagacccgattcacccccaaaagccacctaagacccacccgatcctccatggtactttgtgagttgtctgtgttacaggttctctgtctttattttaccatcttttaagtacctgttattcattctggagaccaaggtcagagtcttatttagctttgcttttctgggccaggctcagaccaggcctttgtaagtattattgagtaaatacacagaatactgcttaaaatagaccctgctctgtcaggctctgagcctaggcttgtattacacatgtgccaaggaattcttggcacagcaggtctgtccctggaccccgcattaaatgccccccacccctactggctcagtggtaaagaatccgcctgccaatacaggagaccctcaatcaatccctggagaaggaaatgacaacccactccagtgttcttgtctgggaaaccccatggacagaggagcctggcagttcatagtccatggggtcgcagaagagtcagacatgactaagcaactaaacaacaaccaccccagatgtagtgatgtgacatgatttctgcagaaccctgacaaaatgagagtccgtaatgtgccccgaacccggtgtgaacttgccccatgacccacagctcagcttccccagtatacttgtcaccaaagggtgtgttcccaacctcttggcaacagaatatttttagcagatacacaggtcagtgccacctggcacttgctcctctttccacagacatcccttcctttctgagcctcacccagagagcaacgagtcactgcaaatgagctggtgggctcactgtggccggacctccggggggccagtgaccgccgggaaccaaccctgagcctcacttcatgggacacaggctgcccgcaaacatgggtcttctcagaggaacagtgagcacatttctggtcgcatctccctctccttttgcatgatcatacccaggctgtgtgcccctgggggaaagcatatttggctacaagatcataatacaatcagaattttgacaagactttaaaatatccaaatctggaggagagttgagaatttttagaataaaatattaacaatatatgaaaacatcaataatatacattcagaacagcctcctcagagctcaaattaggaaggtcacaccaaggtcattgagtttatccccctcattcaagagaaaaatgaagcttggtggaaagagaagtcatgggtttaaaggtcaagacaggtatctactagccacatgaccttggggaatttactttgagccacaagtttagctctgagctaaatctgcctctcctattttgcttgcctgaaactgtttttttttaaagaggagatttttaagtcttaaaatttcatagcaacatgtgaccttagttcaaattctgattctgtgaacctgctgtctgtgacctcaggcaggttactgagcctctctgtgactccattttcttatgtatataggaggatgattaaattccctgtgtcacggggctaccttgtggtttaaatgaggaaaggtatgcaaagcatttaaaatagtgttcggtaccaagtaggagctatctaagggtatgctaatattattattattttaaatctggattggtggttttcttgaaaacccggaagatctgacagcctcatacaacacttggctggaaaggtgtagccactccccctttagagagactgtgccctgccttctagctctcaacctctccctcctccttgtacctcctctgtttcactcagcgggtgtggccagctcaccgctcctccccaacacgctccctcccttctagggccctgagccccctgtttggtcaggaagcagtatttctgtttattggataaatttagaggataaacagggcttccctggtggcttagacagtgacgaatctgcctgtaatgcatatgacccaggtttgatccctgggtcaggaagattccctggagtagggaatggcaacccagtccagtattcttgcccctctgtctctgagctgccataaccactcattctcttgctccagggcctcccggcctggcttctgggtgaacagcactagtggcaggccgctcactacctcacagggcagcttcactgctgagtcttcatcttatgcagggtccaagaacaacagctcacctaccaccttgcctgagatgccatttaatttccactgcatcccctcttctggaatccagagcagagggatatgccatctcctttcagagctgtgcgctgagttcccaagtgcttgggcaaaacttcaggtttcagaaatgcctacaaaaaggctggagtcactacccaaggggtcacgtgctgaatggtcagagtcaggcagctcagcatctccagtggcaggactggaggggaagctgctgaaggcagggggtcagactgcgtcatccgtaagagcactggggtcagagctgggttccggttcctgcttcaccactttcgagctgcctttgtggctttgggcaagacacacaacctctctatttctgtttccttctctgtcagatgaaaataataagactcccgtgatgaagggattgtgcaagattctccttcttttcctttgaatccgtgagtctcagagctgcagcataagaatgaaaacagacccagaagattctggcagctccactcccctcctgggagcctcactcccctcctgacccagggcagtggaacagggaagctgcttccaggcgagggttcgggacccctggtgctgagtagtgacctcaggccctcacagccctgggcctcaggcagtcaagctcaaggtctctctaagacatttcggaatccacagaaacagctttttttttttttttttaagacaaaaccaagcattttccagactggctgacatccctggctcgtcagagcagcaaaagacaggcaggtggtggggctcagacagccgtgagtcagctgtacccaggctaggcacagatagggggccgggagggcacttcctctgcggctgaagggctgcctcagctggagggtggaggggccagcagacctgggaagcaggaccatgcccctgggcgccgcaccatgcatttctggcttccttccctggctctttgcagggcatttctctgcagctgtcaacaccctcagtcccacccagcgctggcagcctttcaggagggctgcagaagagcagtgttcttctctgtctgcagtcctacaggcccctgggcaccccagagaaggaaggtgctaaggaaaccttggtcagcatcacctaaaagcatccaggcagcgtctgtgcaggggcagggggacaaagtggaaaagtcgctggtggtgtgatcttgtccacatcacttgaactccctgggccttggttcacatttgtataaaatgggaacagtggccaagagctggtgggagggctgaatgacctcaagcctgtggcagtgactggtacacctaagggcaaagtttgactgttttcgctggaagggaagtgatttttccaaggttgctcagcacgttcacacaggagccaggactcagatccagctctcatgctgacctctccatgcacagagaggttcctaccagaaagtggggagcgttctggcagccagtccaccgtggttgggagggactggctgtgtgccgcgtccgtggggagcccacagtgtcaggctgaacttgtgctcagggactcgtgagagcatcttggctgagggtctctagcagacatgaggaaagaaggccctggcttggctcccgtctgtccagcaatgcctaccgagcacttgcagggcatcaggcactgtgctaggcccgggggatgcaccagtggatgaggcagacgtgtcccccctccatggggctaacagggaccaccctgtgagaggccacgacagtacacacagctcgacaggtgccgtgaaggaggagtgggtgggacccccaggcccacgggtgtgtgagagagggctctgaaggaagggacccattggcagagccctgaaggagacagacagactgtagcccgcggtggctggcgggggtcgggggagggagtgcagggggaggtggaagaccagaggaaagggactcagaggcacgggatgacattcggtgtggttggcggagaagtgccgtgaagggaagagctggaggggtagctggaccaggaggtgccccggggccttcagcacccgctgagtgaggggcagggctttaccagagcgcagtgggaggagcatttgagtgggcccttgggctgtgaggagcggccagatgggcggtatttggggagagtcccctctggctgtcttgtgaagacagcagggtaggagagaggatggtctgccctgtggccgcccggaggtgggcctccctggaacacatgtcgcatgtggtgttgacgggccgtggtgatggactgaccgacaagactgaaggatgtggaggcaccaaggatgctggcctggccaccaccgggtgtgcatgccatttactgacgcggggacccaggaggcagtggtacaggtggggggcatggaaacaggattctgggaacgtgggttgcaaggtgcctgaagaccaccgggaagacgccaagagggcagctggatgtacagcagagcggtcagagctggagagacaagaggagtcttcagcatccagggggaaagtcaggtgtgtgtggaggagctcacctggaggcaggtgtgaggggagaagcatgcaggttggtacccgcagggagggtgggggtgcagagaaggaacttgccgaggagacccggtcaccaagccagcaggtatctccagatggtaggcaacggggctcacagggtaaaaccactgtcactcagatttagcagcccgtgacattgacaggaacagtcagcaggggagctgggctggggtggcgaggagacgtgactgccagcaggacggccctttccagacttgggctgagaagggaagcagatggagtggtcgctggagccagctgaggtctggcgggcgggggctgctgttgcttggtaccaagaggactgagcccgcgcgcacagtggtgggatgtgtccaaaggtggaggcctgaagctgcaggggaaggggtgggatcttatagggagacccctataaggggccatccaacctccagcacagactggagggactgagcctgggctgggaaggggaggagggcccagccgacaccggacagctgccccacacctgtccctggacttggtcctttgggaaccaccaagctgcacaaccccagtactggcctttgaggagcagagaagtcagaggctccaggctggccaaccagaactgccctctccaagtcctgggagcccaggggccacccttcccctgctctccatcacctgactgcctcctcctctcacctcttttctgtggctccccaatcacattctctcctggttccttatcaggatctctctgcttgggggtggcttttggcaccatccttctacccacccttacctttgggtgcttcctgggccctctcactatcctttttctgttttcatactctcttgagtagtcacctgcctcctcacaaagctgcaagtcccatcctgagtcccatggaattctggttgtgtgtggacattccttcaattctctcatgagcatctcacattcagtagttaaggactagactccggtaccatttctctctaagccgtggctggtaccacctgaactagctaagttgaaatctttgttcctcctgcctggtgccccctgtatcatccagacagccaccaggatttgtagattctacatccagaaggcttcgaatccctgtcgtacaacacgtgtgtcttgaacccagactgtttctcctcttgcagaccgttccccatggcaccaaggaagtatcttctgttgagactttatgtttacctttaagacaactttaaccaagtctccatggcattcaaggctgatggtgatccagtctgccctgcccacaaactctccaggcatcttaacactcatgcctgtgcggctggagtccctgcctggggtcctcccttcttgcctccatctctcagcatcctctctagcctctcccaacccaaggctgtgtcccagcaggctgtgcactttccatgcagtgtgacaaagtggtgtctggggttgtgtacctgccttctcaccccaccccccaagtcacagcaccaccctcgggggatcgagcagagtcctttctctgtgtacctgtgtgtctccacttgggcacccacctgtggtttaaactcgctattgagggagaatgaaggggctgagagtagccaaggtcgacggactgtctgcctgcctccgagctgtcttatgtacagagggaagcacacatgtggtagaaattggagcatctgtaggcctgggtgggaaggggtgaaagacaggggacccataggctccatcatggttggaagtgagaggggagaggctgtcatggaacctctgagcagggcagtgtggaagtggtgtggtgtgtgcgtgcatctgagcgtgagcgctggtgaacactgtgcctctgcctgcctgctccctccctcagagacccctcctgcaggcccatcctggtgacatcctctcagctgtgagctgatggtcccagtggaacaggactgagtcccagccgctgtcacttcctcaccttcccctactccaagtcccctccctgcctctctgaagccccacccagaggctgggtgggagggagatgtacaggtgagtgtgggcataggcaggcctcctgcttggcataggaggcacactctgcaggctgagaaagccacacctctcctaaggcgcctatgccctcggaccctgggtctcacagtcagaaagctcttctcctggaattatgccaggattccctccatgggccctgccgcagccttcccatccctgccaagacactcacacgcacatctacagtgttaggccaatgtggcgttctgacaaggacggtatcgagtgagcttgtgggactcatgggttccttctaagtggaaataagagcattctgattcacggccaagagcgcagtggccctgaggcccaagcaggcaggccaggcaccccaggaggcacccgcaagctgtcggtacttcctgctaggaccccaggtgatccccggagagagacctggtggctggaatctgggtcctgagagcttcccgctcggctcaagacggaaaatactggggagagagcttcaggccccgggtgtcttgactctgaggaccgggaaataaagtgccctccgctctcccgtcacgtgcgcgtctggcgggcctgcgagcggactgtttcggtgctggtcgcccctcgtgggggatggacaggctctggggcaggcagattcagaagttctgtccctttctagctgtgggagcctcgggctctccatggaggttgtgactgaatgtgggcaggtgtccggcagagggtgagcatggctcagtggtggctgccggagctgtggctgtcatctcttttagtctctttgttgcacggtggcccagagcggctgctctttggaagcagaagctggtgctgaggctggatctgggccagagaccctctgtgcccctgtggcttccctcccggcccggagcaccagggcctgttgcctctgagggagaggagggggtgcaccccccgcacccgtctgaggtcagggcaggtgcagagctccaggcggattccccacccctggctgtctctgctccgcgtccccctctccccccgcccctaagagctggatgtggccaggaagcgcgtgcatcttctgaggtgggaacctgcctcctctcctcctgttttgttcctttaccatgacgcctgttgctcataggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaaggtaagagacggtcagcggagcgctggccctgcccgctgcagggagctcccctctgggagctccagcacagagcccgaggcctggacctctctgcctggggcctgagcagccctgatttccgggctccccagttacagagcagcccactgcagacggggcagtggcaccgtcggctgcccagcctgtcctcttagatctcacactggccccgtccaccctccacctatgcgattcccaccacggccaggcagtggcactccagcgcacagctcctggttttgtatttgatctcatcaccctgcttccttttgcatgtctccttagccctttatccaccgacctgatgagttccagcatccacactggtcactgccactcttgagtttggaaatccattccaccctgagccacttaacacacttgcatggtcacttctcatgccagactttgcctccacctcgcctcaccactcagactgtgttcccgctccacccagcttctccacagccctcagcactgggcccggctctcccctcaccttgactggcagccctgtcattctgccctggccacgcagcacctcagggtcagctcaggctctggcagtcacctgtgagaagaaggcagactggccagtgagggtatgaatccagagggctgtgttggatgatgagggcagccatggctgctgcagccacccaggacccaggcgtgaaccagtgaggctgagtctgcgaggcttggacagagtgtttctctatcctcccacgggctgctcctacagggcaggaaaggcatcgtgacccacttcttctttcctggtagccgagtagaccaaggtgcctcagagggaggcctgggctctcagtaaccctggtggcttcagcctcttgtgtttggcagattcctggctcaggatttgggcacgagggtcctgccttccccttcgggcaagttgggggcctccacaacagccccctccagggccacgtggcttttcagtggatgcaacttgagagcaggttcggctttggtgcccattagccttccttttgtgggtatagctgctcccagagagagaggctgggtggctttgaggaggcccctccggactttgagtcttccttcttcctcctcctgatcccttccattctgtcagtgctaggttgggggtcagtttatctcacccccttgctcacggccccctctctgactgggtgctcatctctgatctgctgaccccattagcctgtcctcctctgtcctcggcgccatcattcccaaatggaactcgaacttttccgccaaggttttggttcgaatacaggcgaccatcctccttccttgccctgaccctcttctttcttggtgtctcatcaacaacagtccagagggcccagagaggaccgactggcctgcagcccagccatgtgcaggacagctcgcctagcaggcctaggtcctagtcgtgggctccgtgccccacacacccccttcagccccacttcctctggccttagggggccagttgggactttctggaggagagaggtggagattcaacaattggatagccattgaccaacaattcagataatggtctttgactctgaatgccaaaagctgtttgtccaagccccaccatgaagggaaagaaaatgagtccccccgcccctgcccaagccagaaatgactgttaaagctggagctgtaactatcagctaggacccctgcctctggggcataacccccaccaccttcctctcttccccttgtctggacggactggcaaaatcaggtggcctccagagtggatcactgctggcccaactcccaggctgtccagcggaccacaccattctgttctcagcgtgacgagcccagtcctgagagtgccccctccaccgcacccccacccccacccagcccagggccacacagagctgcctaccatctcggggagccatcatcctctatgtgagactggaaagatccattgagccaagtccccagccagagcagtctcccagagcaatctctattcaattctctctggctttattgagagcaaaggcctggtctttttctgccaagtctgaaagaggtctgggtccctggcaagaacaccccttttccaggagattcctgcattggaagccacatagctgagctatctgcagtcccttcctgggtccccctgagccctggagggtccagagcacacaacctgcatggaatgtcagtgggccctctgagtgcccagggggcggagcctgggatgaaacctgggggtggagccctgaaggccccgcccaggaggatttcctctcaccctgtgatggggcatgtgctgagctctctgccaaggctcctagacccttctgaaagacaaaaaccttccagagccagagcagtgagtgcatctgagatagtggaatctcaaactctgggaggtagaaaggggctagtatgggcggtgacagatggaagcagagccagctcactttggctctctctgcatgaggcaggagagtgagggaagccatgagacactgaagctcccttgactcctcagacccttcagccatcagcccagataccaaaggagctaccctcctctcagggctcctgcctccgtccagctgcctccgtctcctccctccccttgtccttgggctcagactcgccaggctgcatgagaaatgaagctgggcccggtggtcttcagggccctccgtcgccactacctggctgcaccggctagagagccttcctgtccgtctctgtccgcctgtctgtgtctccgtctctgtgtcagacgttgtgacagcagctccggtcctgggtgctagcaccggcttgtctcagtgagtgaggccggggaaggcccactgggatgtccctatggaggtctggggtcctgtgtcctcttctgagaaggttccccgaggccagcagaagggctgtggtgggtacaggcccttgcgccgatcgcctgcggacagagctggcagtttggagcagccctcaggggctgagggagggtggttggtcaaagcccaaagccgaatggggtagacacggttttcagcttatgctcttggtagaggatccacctgtgttccagatgcccatcatttccatccgcttgcctttcctccttcattccaggatggtcagatttggggtgagggggctgggatgatgtgaaaagctgtgaactctgcttggaaagctgaggctctgacccttgacaaggaaatggtgtccaggccaaaaaaagacacctgcagccatttggttcacctccttcaattcacagaggagcaggcaggcatacagaggggacactcagggagggtgctgggtaacactcagggctgcacatccgcccctatgtccccatggcctatcccagcagccactcagactcccagctcctccctgcagcctccggggcaggggcagaggagaagctggtgtccaggggctgcctggtgccctctcctgggattgctgagcccagacagactggtggaggcatttacatctcagccatcatctcagcatctctctctcctccacaaccagtgcgtggctgtggcagagtctcccgggtgctccatgaacactgactgttggggcaggggggacacacagaatgggaaggagggaggttccacgcagtggcatctgctctctgccaggcacgctctgctgccactctacatgcgtttgttcgtccgcttctcccagcatccccatgaggtaggtacaactttacagttgcagaaactggggctcaaaaggttaagacacttgcccaagaacacatagctagcaagcgacagagcccagactcagacccaaggccaccaagctcctacatgtcttggtctgtcccaccagtatggagcacgcaaggcacctgcagtcctgagacctggctccagacggggctctgcgctagctggcaacgtggctttggctgtttggttctccgtgatggtgaacaggagctgtcccagagcatcccgtcacctcagacagtggattatctcgtccagtggcatcattagcaccaaggccaggagtcagaacagaagcaggaagaccctgggcctggtagggggtgggtcacatggtctgggaggttcctcccgacactttacttctgtgatgagaagaacatttcccactcacggttattacgcgcccttagtgtgctcagcacctaacttggttgagtaagagacccaacccttccggacagaacagggccaacaataatgtcatagccaaaatgagcagtgtgcatagtcccctggggtctggggtattcaggggatggcaggctggtctcagaacctcaggggacgtttggtctctctggcctatgtaacactgcagctgccttgaccgccccctgacatcctgctcaggctttgcctactcacaacagtggggccagaggcccatgatgttggacagggacgttgggggtcccccagccctgggatgactctggaagttatggctgtgctccccatttggccaggagtagaagatccagttttctgtccagttaaaggaagaaaatctgagggagagatggagtcacagaccaggatgagcaggagggaaggggcaggaaacagctcctctccatcactgctgcccttgacctgcacacctcaggcagcctcagcttaaggctcctgttacctctgagcaaaaccttaaggttccttaaaattctcagaataattaagaaaaaccctttggttcatgcatgggtgctctctccctagtcacccacccatcctcccgttgatccatgtctcccatcctcgcatcctaagagcttgtcttcctctcgtcttcccatcttcccctctcgtctgcctctccgcctctctcctttgtcctcccaccatccacccttccatcctgcccgtcctttcatccccctctatgtctgccttccctattgggtgtgctgcctccatccccccatccaaccagccctctcccccttgcccagatctccttctctccctttctccatcttctcatctgtttagggatctactccccatctacccttctatttatttttatcctccatctgtctgtgcatctgcttatctgctcatcgagtatcccacccgtctgtctggattctccctcttcatcctgtttgtcactccatatttcctcttacccacttattcatccatccatctatctgtccaccaatcgttctatgcatctgttcctggaatcccttcttctcttttccatccatctgttcaaacctggtaataagatgagtgagacagagttcctgactcaagggccttgtgatgtattatatgaaggaccatggaaatatagccatccctagagcaacagtgagcacatcacagttggaggcgattggtgagcccaaaggaacatcgtgaggcatctggccagcatcctgaggcgagctggggctctcctgctggtccttcgcagagcgctcctgcccatagggctttgtgacctgtgaagcgctgtgcacacgtcaggaagaatcggtgtcacagagtttcccctgattccacagagcttctggctctgctcttcagcccactacggacagagtcagccaccccccgagggctttgtagtcacggggaggacggagcctttgctcagccttccctgtgcccaccacccttggccatgtctgcatggcagtgactttggaggcccaggaaggggacatgactctctaaggaagtcaggacttggaccccagccttgtggcccctaggtccctgtctagcagacttcgctatgccgtctgccctttctccatgtctattaatagcagtaactttgtcctggttcctcctcccaaaccctaagatccctccctgtgggctggcctagcagtatcctcagccagaaggacatcctcagcacccactcccatgctagttcatgggctgggtccctgctctcatcccagcatttgaaatggtcagtaatcctgtcaccagctcctgggcccagggttaaatcagaaaaacttttgcatatgacttgtcttttaatctccttttgtttttttaaccagcatctcacttcctcattataccctctgtccgctcacagcccctcacccaccctacccggctcctctgtacatcgtgcacggcggccgtggctgcacccctgacctgagcacgcgggcagagtgatgtcnnnnnnnnnnnnnnnnnnnnnnnnnnnnnnnnnnnnnnnnnnnnnnnnnntccctcctccccctcccccctgcccaccttcccctccctcccctggcccccttgcccgccctccccctcctttctgtcctccttgcctctgctccccctccccttctccttcctcaccctcttcctcaccctcttctccagtcttcccaaatacaaagagacaaaggctaagttcacggaacgatggcacccacgcccctccttcttacagcacgcgcctggagccagagcacttgagcattgctgactgtcacgcaggtagagcacccggcacccggtgggtgctcagtgaatgtatggtggttacattaatacacgagtattatagtcaacatcgattgagcatccacctgtcaggcatactctagacacgtgccgtggttatcttggcaaaccctcacaatgacgcagtgaggtacatacttttatatgctccacacccacactcacacctccacactctggacatgggcttggtgctcaggtcttttagagctaggggctttcaagagacccaaagccaggcagacctgacagccccctatcacctctcaatcccaccccacgtcccagcaccacaccccagcctcagtcccccagtagcaagagtagagccatattagggccagtttctgtgaacacaaggcagagtggaaggtgagtccaagtcagcatgtctggccgggccctgtcgggcctcagcatccaagaaggaggccagagcagctcttgggggtagataagcaaccagagatattcttctgcagtgagcaaacctttggccagatcccctaaaatcagggtcaagagagtgtgaaaaagcgaggtgtgtgttcctgtgtcttgtttctttctgtttatctgatttgggaatgtatgtgcagtcttaaaaacaagttagatcatatttccttttaggtgaaatgaatcagctttattgaacagaatacactgaactcagagctgtggcctccaaaatgagaatgtggggttactgagttgatcaagaaagcacgtcaagccatttacagatgtcttattaagtcctcataactgtggtagaaactggtgtcactcctttttaaactgaagacatttattaaagctcaaacaggttatggaagttgtctgaggtcaggcaaaaaccactccatgtggctccatgccactccagtgcctggggggctggacaggggagctgcacccaagcccagagccctgcctgggtgggaggcagggtgtgttcactagcaccgcaccaggggtccactgggcaagttcagcttcattttcccagtgaggccgaaaatgatgaccagatgaccttgtttgagaatgcctgaaatcagtgcagtcgttctagaaataattcctgccagcaccagccctattctaagtcctactctaggtactagaggttcttcaatgcatgaaatatagttcctgtcctcaggaagcctgcattctagaggggagccgggtagtgaacaaatgtggaatagggcaagggccttgagtatgaaataaagcatccatgacaggtagggaagtgtggggagtggcctctctgtttaggtgatgtgagccgcgaacatgaggcagggggtcaggaagccacgtggagcctggggaagggctctctctgcaggtggaacagcgggtgcagagcccctgaggacaagagttgggaagtcagagacagctgcggctgtgaaggtcaagggatgggtttagccgcctgctggagcgactgccctgactctgtacgcagaggatggccggtagggggcgcggctggaggcagtgatgcaggctgagcacgtgttggactggggggggcggagggaggtgaagaaacgtgctgttaggttttgctgacacatcagggcgggggcaggtggagggtgaacgcatgagaataaaagatccaaggatggtttccgaggtttatggcctaggaaactggaaggatggagttgccatttcccgtgatgatgaagattcagggaggagcttgtctgttagacgcgaagtggttgggaggtggccaggccggcgccgcagccccgcccctgagggtgaggaggttgagcaccagcgccaccgtgtggccagacctccccagcgccccggcgcgcttcgttccacccgtcccttggctccagagaggcgggactttgtggagattgacagtgaggggtattaggaattattgatcggcaggggcctcccgtagagctctgcaagagcccagatgtggggggcctggcgaaccttgtgctgggcacgggaatcttggattccgtcactcctgagttgggtgcctagggcagggcaccagccctctgtccctcagcgtcttcatctgttacagactttaggatctttcctgccgaatatcaggagccgctgatcctgactccctgactggtagcactacccctctgaccttcaactgcagcatgagatgctggccgtgctgcctgtgtgttgaggttgtggggtacttggggtgagaagagctgaggtttattgggtacttactaggtgtcagaccctcacaatcctctcagcagcttcatgaggtggcttttattattcttacccccacccccaccattttacagacaaggaaactgaacccagagagaaaaagtaaattattcgacattgcacagtaaggaaggggtgggactgagattcaaacccagaccatttcctgcttctcagtgcataaaaacatttttaaactggcagtgtaatgatgtaggggttataaaccttagtcctgactcagccattactttctgggtgaccttggggaaacatttgcctgctctgggcatgggtttccccacaggttgatgagaggtgaggctaggtgaactcctggagctaaagtcttagggcaaagctttagggtatgttttgcctccccctcacgacccctgctctgtggtccccagccccttccgcctctctggtcattctgctcccagctgccaggaggtcatgcccttggcctcccttcacctgacagctccaccccgcagttttttatctacatcctcttgcatgcccgactgtcatccatttgctgagtgctgagctgtttgaaagcacaaatgctgggctttctggtcccggtgcagcttggcatagtggggtccagagaagcatggttgtaccagtgacctgagtcagctcatgtgtccagctctcttagttagtagttgagtggatgctgacatgagcgtagtgttgggccagcaggacccaaaccctcaggatcctgccaggtgggcgagatgttagcggagctctccccagagtcctgattgctgccaacttcagagatgcccaaactaggtctgtgtcctgttagagctgaccccgctggtggggctgccccagcagaagtcagaccaggaggctggtatttcagagctctactctcctccccagctgggagcaccaggggttctacaagcaccttctctggacatgagtggctgggaagaggccctctccgcaggctgaggtcagcttagccaaaccttccaagggaacagggcctgccacctgccagatgctattgtgccaggcatcagcagcgtggccacagtggcaggtgtgtatgtgaactgaccgtgcccagtgctgctggccccgccagcatggctgctgtattccagaataatagatgtctccatgaatgcgctgagtggctacagttattaatatttgagcccttgatatgtgccaggcttgtgtttcctcctcctagcaaaccttatgagatgagactgtcatattcatttgacaaagatggagacagaggcccagcagagtgacttaacttgctcttggtgaagccaggactgaatactaaccaaaaagaaaaagaaagggaaggcctgtcttgtttgctgtggtttgatgccagccttactacttactttgcctgggcaaggtaaggtgaactgtctcatcttagttccctgtctgtaacatgaagataggaatagtgcctaccgggcaggattatttgtggattaggtgaattaacgcacatgcaggccctagagctgaaccttaacatggtagatacgaagtcatttttgctgtttacaaagtgctcccataccctcaacgatcttggccgtcaggcggggtttgtggcacagagcagcgtggggtgcggctgtaacctcgggcctcctgtgtctgtccctcaggaaccagtgatgacccattccaggactcggaagggcgagagggcgcagaggccgtggcagagcaccagttttcagacctggacgactcggactcggactcggacctggacgaagacgaggatgaggacgaggaggagagccaggacgagccatcaggcccgtcctcggaggcgcccccacctggcccgccagccacgctgcccgcagactcctcacccgttcagggccctcagcccacagaggccacccggggcagctcggtctcagaagccgagcgctcggcacccagcagctgctccacatccagccaaagcatcctgtgcctcccccggctggcaccggccccccggggcccagtggagaaggacacaggctcggccctgagctcccaggccctgtccccaaggaggccgtggtccccaagcaaagaagcaggcagccacctaccactcaccccaaaacactcactaaccaaaagctactcgtctccccagcgacattcaccggcccgagagccactggcctcagccccgagtccgcctggctcccagacgggccctctcccctgcgggtccccgagactcgagctgtcgcctcttgccctccaccccctgggaagggaactgccacttcgagcgcgcctgccccccgaacgcaagggcgctgcagacccaggcccccccagacactcgcccaccaggagatggtctccaggccaggccgagtcaccaccacggtcagcgctgccagggaagtgggccttggcagggccgggcagccccttggcggccgagcgtggcccaggctcagggctggccccccgggctctctacccgcccgcgcctctacctcacaagcttctcggcagaagcccagcggagacctgcacctccacatgggtgagttcctgtcccccaagtggctgatgggtggggggccgcgagctcacacctccctgagcgtcacacccagagctggacccctgccagttcagcggttaccaataaggcgtgcattgggcaccacttacacaggcactgtgctgggtgcctgaaaccagtcagctgtgtgtcagaagcagcggagcatggactgtggagctggactaaaagaaagtgaaagtggaagtgttagttgcacagtcatgtccaactctatggactgtagccggccagactcctctgtccatggaattcttcaggcaaaaatactgaaatgggttgccatgcccttctccagaggatcttcccatccctgggatcgaatccaggtcttcagcatcacaggcagattctttaccatctgagccaccagggactacctgatagtttttaaattctggactacccagaattaaatccgggttctgtcacttacgagccgtgtggctttagatgtggtataaacactcatgccatctcctcccaccccatttccacgtattctttgagcagatggcagagcccaacccaaatctccacatctccaacatgactgccaccagcaccctccgagtcacttgagccagctccttcccatcttcccatcagcaccgtcactgtcacatcatcagtgccatctgccatcagtacactccagccaccccataggcttgatcaccgtggtcacaacatcactgccaccaccacggtcacgatccccagcactgacacgttatcatcatcggcttacttttcctctcccaacaccttttctgtcactggagtgtcacgacccaacatctctgctcaccgccagcagtgtcagcaccatcactcaagcgattcaagctccaggagtagtaccatccaggaatcttaacttggtttttaatttggggctcaagttaaaattcctggtggtgaaaaagtgaaagtcgctcagttgtatccgactctttgtgactccatggactgtgtagaattctccaggccagaatactggagtgggtagcctttcccttcaggggatcttcccgacccagggatcgaacccaggtctcccgcattgcaggcggattcttggtggtgggaggaggttaagagcctggggtgggaactcatgttcaagggtaaagttgggtcagtattgtctgaggaacaagagaggcagcagaagcaagagagagggccagcgcacagaagccaacagaaggggcagctccattctctgaaaacgaacgcgctggccagaagcgtggggaccttggttcctgagtgtgcctatggccactatagggctggagatggcccattccagagagggcacccacccagggtgccaccgttggcaagggttgggactcaatggtggcccagctcagctaggacctgctctgtgatctcgccaagccccctcctcactctagtcctcagggtctccaggtgcccagcaggtaaccctcgccttcctctgtcttcttttctgaccctagcagaaggccgagtcgccaagtccgtcctgttcacctgctcccgctcatcctctcttctcccgacccttctcggccccccatgacttccacggccacagcccggcccggacggagaacatcttcagccacctgcctctgcactcccagcgcttgacccgcgccccgtgccccctgattcccatcggcggaatccagatggtgcaggcccggccgggggcccaccctatcctgctccccgggcccagcgcggcctgggtcagcggtttctcggggggcggaagcgacctgacagggtcccgggaggcccaggagcgaggccgctggagccccaccgagagctcgtcagcctccgtgtcccccgtggccaaggtctccaaattcacactctcctcggagctggaggccagggactaccccacggagagggggaggacgagagggggcctgggcagacctcccgactgggagccccgtgcggcccaagtgcccacagagcccacgccgacgcacagcccccgcacccccccagagacctcaccccgggcacccccaggccaccgggcagagtcccggagcccccacctggagtcaccgcgggtgccggccaaccctgcggcctccgccaccccgccgctggaccgcagcagttccgtgggctgcctggccgagaccgctgctcgcttcccagcccggaggaggaacctctctggggaacccaggaccagtcagggctccccccagccctcgggaagtggggggtccgggacacctccacaccagcccgaggagcgggggccccggagcacttagcctctccctgaccacttcagcatctggtttctggtgtttggcaacagacgtttccagccgacttcctcgagtcatcttgctgtcacgggctccctgtcccatctgttgatctttccaagcagcttctgctcagcccccatctgtcttatcttcccacctcgtatgcagttacctgtgcctttttctatgaccttttgttgcttgaaaagaaacaacacacacacagacataaaaaaaaaaaatcccacgaggagactgaggctgtgaatatttagatgggacctcaccctgggccactgcgatcagcagccccccacaaagctggcaagaggcagtcagttgctgaaagaaaggggatgcactgagggagagacagagaaaaaaaaagaaacttttaaaaatatataagtaaatgtaaaagcaagcactcctatgtacagagtttatggttcctatttattgctgcttcatcccaccccagctagtggcctcccctggctgctagcagaagggtcagcggcccaaggcagagggacaggctgggagactccatgggcaggcccagaaaactccaactttccttttccaaagataaggtaaattttcctaggatttcaacacaaactgtttggagcaggtagaaggtagttgctggttgggtccccagggctcgcagacaccctggtggtctgactcgtgaccccattctggcatttgactcatagacaaatccccccaccccggcacctctactctgcactctgccctcaacctttggactggggaaggagccctgaccacccatctcccggttcctgagcacctgacctcggccttgctctcagggccccagccattgctgcgcctttgttctagtaactacccacaaggctgaagggacaaggcctaacccctgggggtcaagatccaaggtgcattgccttgccattcccaaggccaggcttgggcttcatttcacatttggtccctggggtacaaagggctctatttcctccatgactgggcttttccggtacttagcactggaagtttccaaggactcatttctggacctctttgcagcaggaccagtcctcctattggcgtgtcacacactgtcaggcctctactatccccaggaagtacccagaaccatgactggtgggaactgcccaggcctcctattggttggcttaaatctcttttaaaaaataaaattatatatgtgtatatatacatatatatacatacatatatatatatatatatatatatatatatatatatatatatatatatatagaaagagaatggtgtttgatatttcccctagcctcctattgtccgaggtcatttcaattcttctccaaagcaatcaagaataactagtgcctcatttctcatccccatctcctcctttaagaagctgccctgtgttttctggggcaaaagcctgctttgtaaaaaataataataaatagtaataacatgactagaaattaaaatcccaagttgaaatatagaacttgaactctagcatgtttacccagccctgggatatgtggggttttccccaacctccagaaattcttttcttttgtctctaccagggggagaaagcacaaggaccgtggtcacagcccagccaggctaggtgctaatgccgcagagcagggacctccttggccggtcctcattcctcagccaggctgtatgaatcctgtggccagagggggctcctgggctgttgaagttgcttagacaggacaccataaggtgcagagggctacaccatgcagaggcacctctgtgggctcctacccttgggcgtaattccctcttccaccagttcaggacttttccttccttggactctgctgccaggacaaactagccaggccacctggttcatttccctctggctaagacaaaaaggggacaatagggatgggcttccctgggagggggtggctgggccccagggtgctgaggctagggttaaccagcacttcctggctgcctgacccagggtctgaagctcttggtccccctggaagaaggctaacaagcccagccttggctatgctggcacttgtgggtcctggcagaaagctggaaggagccccggaccccagtcacagccttggccagaggctgggtttttcctcacccttgctttccaaccttaccccagggcaaaggtgagggacatgggaaggtggctgcctaaggactggagacttcaagggccgaggcctgggagctgaataaagggcattgcttcagcccaggcttgaaatcttcctgggcaagatcttccagctcccaacctacagagcagcaaacagggggctctgctagagtagcccctgaccttgggggtagccaggcccctcctccaagccctgccccacagctctccccggggcatcattcctctggtactcagacagcccaactactaaggtttccttcctggagccctagtcatggctggtggtggtcagcaggggagagtcaggcacaggcagaggggatgggggccaggagtcaccagagacccatttctcaatgacagacacaatgtgcaagcaatctggccaaaaggttgttgccctgcacaggcatccagagaaatggacttgatgccacccgcctgggctgtatgtcactgggcatggctctcaccctctctgcctcactcaactcctgctcccccaaacacagagctcccagcccgcacgcacacctgcatgataagggaaagactctcacatcacaccctcctcctgccctgctcccagccactttcacatttccagcctgcctgtgacactgttgtccctgttaagggacacagtggagaaagcagtgcccattgttggcacagacacctgtgcctgttctgctgaaatgtgcaggacagtcattcctgggtacaggctggctctggtcctcgggtgttggcagccttgcgggctggagaccaacttgctggggtttcagagccagctcttgtcatggggattccaagccagccggcccccagttctaccctccaggatgcccttcaccctcaggacaagctcagggtcattctgggcactaacctgttcctctccaaggcaccttttacaagcctacttcccctgccccaccacccaccaaggccccgactactaagaccctccaggaagtcaacagcagcgaactgcccactctcccacctccatcacctccaacttccagacccagcagtcccttcacctctctctgtgttaacaagtctgaaagatttaatttctgggtccaggtagcccctgctccatcctcacccaacccttttgaataagaataatcaagataactaagctgaattgctttctagtcctttctccagacaaaacctcttcaaaataaaagtcctgcctggacagtcgtccttggagacagatctgcagcactgaccaaggggagaaagttcccaaagacctgttccaccaattctgctcctgagtcgtgaatcctgtctgctttccatcagaaaactgcttcggcacttatgatcactttactaagcctagtgttaaaaaaggaagagaaaagaaacagaaaaaagaaatgtataggcaaatgtaagataacacgctctctgtaagatagaaatttgccttttttttttttttccctaaaaggtgtatgtattctgtatgtgaaattgtctgtagagagtttctatgttcttaaatggcaatacattccaaaaatcgtactgtagatatgtacagcaaccacactgggatggggtagttttgcctgtaactttatttaaactccagtttctctacttgcatcttgcaatgtcggtatggtatatatatcagtgcaaaaggaaaaaacaaaaactcccacaggtctaaagcacagagtctgatgtacaaaaagaaaatactgctcagtattgatgtgtgacctttgttgtaaattacatctgtactgtgaatgagaagtttttacaagtataataattgcctttattatagctctggctgagtgttcagcctgaggatattttttaaaaaaaaaacagcacgttggaataaatttgaaaatcccaacagaggcctgcttgcccggctcatgatttttcttagggctgtagaatgtcagagctggaaggacactccgagtcccaagtgctttttctgctacagagaaatcagggccagggaaggcgagtggccaggccatagtcacatagcctgggattccaagggcccggcccttccaggcttggcaggaggcacgggtacatggccatgtggtttggggtctgtattcatttcctagggctgctggatcaaatgaacaaactaaatggcttaaaacagcagaaatgtgttctctcacatttctggaggccagaggtctgaaaccaaggttcctggggaggctctgagggaggatctgggccagacctctgtcctcacttctgggggctgcaggccatccttggcctttggtttgtcatcacagcactctcgtctctgcctctgccttcgttctcgctgccttctctgtgtgctgtctaagggtcctcatcactggacttggggaacacgctcattcaatatgatctcatctctagatctttaactgaagtatatctgcgaacactccttttctgaaggaggtcacacttacatgttccagggtttaggacatggacttacctttgaggggccaccactgagcccctcaaggtaagacctggaatctgatcgtgacagttattcactgcctgtgtgacactgcgcaagttacacaacctctctgggcttctgtttcctgttctgtgaagtggagggtttcctgtgaggattaaatgagagagtatatgtgctaagtgctaaatcacttcagtcgtttccgacttggcgacactgtggactgtatagctcaccaggctccaccatccatggggatcccccaggcaagaatactggagtgggttgctatgccgtcctccaggggatctttctgacccagggatcaaacctgcggctcttatgtctctggcattggcaggcaggttctttaccactagcaccacctgggaagcatgcatacagcatggttaacagaaccttgaatatggtacggcgtcaacaagtgtcctctgagcagacctcacacagggtgctgtggttacaaggatgaaaaagtcaggtataggtccccaccttttgtatgcaacaatgacttgctctgcaccaggcagggactaatcatcagatacaacagtgagcaaatcagacagccctgccttcagagaactttcattctaatgggagaggccgtccttaagcaaataacgacatcatcaattcctcagtcccagtggccgtagttgttgctacaggagagaacaaagctctcacacagagtaagtcctaaaactcctgtgggctctggagcctgggtgggttgtggggagggctgcaggtggaggtggagtggaggggaagccatgataggagcagacagaagaagaggtacgtggacaaatcaagagaggccttcggggtaaaatgctggacacaagtttagcactaagaacctaagagggcctgcttgtttcagcggcaggaggatcattgctgacttggggaaaagccggcctgttccagcgcccagtctgcaggcccttcgtaaacactgccagtgctgaatggattgtggaggcagggggtggaggctggagagtgaggagaagagggaagtggggacggcagacccagacatcctccccaggacctgaggggagggcaggggagagctgggcagcagctggagggcagcaaggcgtccagggaagaacggagatgggaatgaggtggtgagaccccagcctgcttcattaggaggagatgtaagtaccagatgcagaaatttcccccagtgtgacccaagggaagaggtgcaagtgataacagtgaccggaagttgagaacatttccgccacggaattttctctgtcacctgctgagaagggaagaggaagctccagtatggggtagggggtgcggagcgggggtggtgtggactaaagacttgagaaagaaaaggttggaaattgtctttgttcattattccagaggcaggacagttgtggatgaaggcagtgtggaccacacaggcgtgggtgctgggcacaagagatgaaaaggctgggaagcgagtatccatggtgccagtgacctgaatgttcatctctgctgaccacagggctggactggaaacccaggctgtgagctaggcttcataatccaggatatgggctgtcacgctgcagaaacaagcaagccagaaactccagaactgaaaacaatgaaagttgaactttcccctctgccatctgtcccatgtgggtcagcagctgaagtgtactcatcctcatcatttggagacctaggctgctggacgctttatcccgtgttcctgtgacctcagaggcagaagaaaggagagagctgtgaaatgttgcattgacagctaaatgctctacatgggaaaagacatctctcctttcaaatttcacctgccaaagcagatcatattgctgtgcctagtgacagagatgaggaatatgtgtgacagtcacacaaggatacgacttcccagtgtcagaaacacccaagggctgagcagatgtcaatgatgggatgggggcagggacagggcctcatggcatcggcctcaaaggtgctgggtttttacagggagtgaaaaaaataatggtgtgcaaggaggcctggaagaaaatggcccctggcattttgatcatggggtgtggaaggcaaggagcagctgtctgggagcgagtccttggggagatcctgaatttcagtcgagaccagtgggaaagtggaatcccaaaaaggcccaggagaagaagagcacagaatggagccaagtccggcctccagcattttacaagccctatttatagtccttgggcttccttggtggctcagtgaaggaagccacctgccaaggcaggagagataggttcaattcctgggtcgggaagaacacttggaataggaaatggcaacccactccagtattcttgcctaggaaatcccatggccagaggagcctggagggctacagtccatggggtctcgaaagagtcagacatgactgactaaaaacaacaatgtatagttcccaacgacaacccagggagatgagacttacggtccccatttttagagaagaaagtggaagttccaaagagcccccaccaaggacttcctgctaagactctgtgctcccaatgcaaggggtttcagatttgacccctgttcagggaactagatctcacacgccccagctgagagtctccacgccacaacgaaagattccacatgtcataactaaagatccgacaagctgcaaagaagatccaggatcctgagcagatcctggaaagatccactttccaagttacaacaaagactcggtgcagccaaatgaatacaaataaagaaagaaagaaatattaaaaacaaaaggacccccaccagccaaagatgcagggctggttagaggctgtgtgagactgactctagcctgactctggtgcagcgcctctgggagccccaagttcctccctctcatctcctccctgtgctctggccccaggggagccctggatctcagactcttcacctccttctccccaggaacccaggggaagaggcaggcccaggccaaggcttcttcccagcagctgcctggcttctcgcagccatccaggatagccccgtgtgtccccgtgtctgaggctgaaggcgcagggatggaccatcagactcaggggctgggattccagtgctcgagagcatgccaagtgcatgcaaactctctgaagaacctgactccccagcctgctgctggcacccaggcccacctgtcactcacaccaagcctcccatggcctctcgtattcacgaggcaatttcccttttggagtgagggagatagggcacctacttccacttcacagaagaatagatcccaagattgcaccctggcaagtggcagggccaccgacccgggtcacacctgacccagaacctcaggaaggcttgggctgagccttgccactgcccatcagggctgggccttctccctaggcctagaccctctctgggcttaagacctagagaccatgcttactcctagagattcccagggacaaaccacggctggcaggatggcctcagaaggcaggccagcctgagatgggcatgagcagggagaaacaggaagcaaaaagagtcaaataaggatgggggcgactgaggagggagcagcccagggctgccctgcgtgggactcatcactgccatctggcccggggagagacttatcacctcgtcactttgtagaggaggaaggctggggcttggacaggtgatgctgctcataaggccacagtggtcaggggcagagcagagacttaaaaccaggcccacacattcagggagtggttgggactatggaaagggaatctgggcctcttggctacctcttagtcctgaaatctgggttgggggaccccagcagacatatcctttaattccatccagcctcagccactttacagagacccagctaccaacctcccccttttataaatgagaaagttgatgtccagagccgggaagagcttggcccaaggccagagctaggattcccgaaccctcagcagagccacctggaccactccgcccacccctccttaccccaggcccaggttcacctgcccagatctgcctttttaggaaaggaaaggagcagccctggtgggggcaggcgggtgggcaggcagccacgctaatccactagctcccggaggctctggttaccgtggtttggggcccgggcaaccctggctgggagtgccagcccagccaatcggtgctgccgctgagctactctgccagagccatacaaggctttgctgcagccctatcttgagccaccacaggacagccccagcgtcggcagccgccccgcccgggagcctgccagcccggcacgtcctcggactctgcctaatccaacctggaagcaggcagggctgcagcgcacgtgcaccgggcccagggttccccaaggccaggaaggtggcactgccagggcagaggccagaatcggggcaaagacctagccgggcatcggagatcctggctggggtcagggatgagctcaggtctggtccaggctgagctgtatctctctgtaagatgctcttctgttcccatcacccctttggcctgactgactgcttatccttccccattcaccgtggagacggggctcagcacagtgagtatctggtcccttctgaggtcttctcagggtccaagtcccaactactctaacccatccagggtctgaggctgcatgcacctctcagaattggggcgtccatttctaagtgcacgttgtgagcatcaggcacatacagccccccctgtggtctttgggggtccactgtcactgccatggatctgggccttggctgtggaagcaggtggggaccggtgacccctgcccagtggagcccatcccatctgtcagtgcataacacctgagtgttatgaattcacaggacccccgaggagtggaaactattggccctgtttggcaagcaaggaaatcaagtcacagagaagttatttgtctgaaactggagtgtcaggattcagccccagagtggtctgactctagatctctagaaatttccgatcctggagggaccaggggctgccatttacactgaagtgtgaatggaggcgagaaagtcattgtctgagataagaggaccctttctttaaaatatgtatctttttattctttcgttgtttttggctgtgttgggtctccgttgctgtgcacaggattcctctggttgtgacgactggggctactcttggttgtggtgcatgggcttctaacagcggcggcttctcttgcggagcacaggctctagagcgcacgagtctcagtagctgtggtgcacgggcccagttgccctgcagcatatagaatcttcctggaccagggattgaacccgtgccccctgcactggcaggcagattgccaaccgctggactatcagggaagtccaagggtgccctttgttcctgaattgggtagggccaggcccccagtgcacggccattgcccaggccctggtcaggttgcccacgcatgcagcggcccctgcagagcgtcccaggccaccactgtcaattagatttgtcacggaagttcactgggttccaacatccttgtgtgtcctacgtgggccaagttgagctcaaagccaagactgcggtactccccagggccacccggcaggtgagagaaacgtgccgacctggggggtggcaggccaggctggcattaggctctgtttgctcacccaagaaaggaagagataaatatagacacaggattactcagacacagcctgggaaaaccggctccgaacctcgacttcagccctggcccggtctcaccttcacccgcctgccccctcggtgtctgctgccaggcctgccccacctgttcccaggacgccccacctgcaaacttcaggacagccgttcctgcctgccttctgggggcaggacagaaactgaggcccagagagagcagggcacccgcctcacatcccacagcaggttaggagctggtgacgcgagggctgcactgcgggagtcagtttatcaggtccaggcaatgcaccagcccagattcggtttccatatttgtgagatggggacctggtacccccggccctcaacgccctggagcctgcgtgtagggtagagttggagaccacgcagcagaaaggggatgaagctggaggctcaagcacaggaaatgctggcccaagccgcatgtgtagggcttcagcactgggactctggagccaaatggcctgggcttaatatccccctccaccattttcagccaagagatttggggcaagtttcttaacatggtgccacaatttcctcatctctaatataagaataataagaattgttattctatacaataaataatatgtacagtattatttgggcttccctgggcggctcaatggtaaagaatccacctgccaatacaggagacatgggttcgattcccgagtcaggaagattacctggagaaggaaatggcaacccacgccagtattcatgtgcttagtcactcagttgtgtctgactctttgcaacccttttgactgtagtccaccaggctcctctgtccatggaaatcgggggcaagcatactggagtgggttgccatttcctcctccaggggatcttcctgacccagggattgtatcacatctcttgtgtttcctgcattggcaggtgggttctttagcactactgagcaaccagggaagcccaaataatactgtctataatactaaaatcccatggacagaggagcctagtggactatagtcgatggagtcgcaaagaattgaacacaagtatgatgttatatatatgtacatgtatatgtgtacgtatatacacgtacatatatgcacatacacataggtattgatacatatatacatgtagacatgtgtgtctacccacatttgggtctcgcaggaggtgctagtggtaaagaatcctcctgtcaatgcaggagacataagagatgcgggttcaggtccctgggtggggaagatcctctggaggaggggatgccaacccactccagtattcttgctggagaatcccatggacaaaggagcctggtgggctatagtccatagggtcataaggagtcaggcatgactgaagtgacttaccatgcatataggcaccggtattcttgggtgggaaatcccatggacagtggagcctggcgagctacagtctatagggtcacaaagagttggaaatgacttagtgactgagcacgcaggcacatatatgtagatgtattatttacatatcattacaataataatagcctaataacaataccaacctctcagagtgttggggtggattaggtgagattagtacaaagcacttacccagggcctgacacagagcaatgactccacatgcatgtttatgatgatgcagccactggggcaggtgggggcctgggcgcaagaggcgtgggtgggcgtctccaagtctcctgccctccaagggaagagctcagccctgagctctatggtgcgttggtctctcctgcactgtgacccttgcagcagctccctgctctgcctgaaagcttcaagagtcaggcagacatggatttgaaggttggctcccacttacgggcttcccttgtggctcagctagtaaagaatttgcctgcaacgtgggagacatgggttcgatccctgggttgggaagaccccctggagaaggaaaaggctacccactccaggattctggcctggggaatttcatagactgtaagagtcggacaaaactgagtgactttcactttgccaccacttacagactgtgtgaccttgggcaagtaactggccctctccaagcctcaaaatccacttttatccctcttgggattggtgtgagggttaaatgggggaacaagtgcgaaactctcagttcagccaggcaagtggactctctatgcttgagctcatcctgagccccatctcttgtttcctccagtttctctcagtggctatgagctgagcccaggacaggtgcatgaccctctgggtgcatgaccctcacacatgcaagggttctcagttatgggaaacactcaccagcccctacatcatgcatgagctcatgttcctgcccttgggtccctggagccatcagagatccgcaagttccccctgtactcttcatgcactcgtgcatatccacacaggctccctctccacattcctgcacacgcacatgcgtgcatctatggacacacagggcacagctgtgtgcgagctcggagaggctggtgcccacaggtgtgtccctgcacacctcaccagcacgcacgctgccacagtcaggggtgttctagccaggcctgccctagccaggcctgcccctgaggtggccgtcttcacagcagaggaatgcagacagctggggatgctctgccagcggacgtgagggagaggcccaggggaaaccacacgggcaggaatccaggcaggcgttccaggccaaggtggagtcctaaggtgtcaggaagtgcggggggggggggcatgtgcagactctaacttgctccagtctcctctctcatcaccctgtgtcctcagcctctaggacttggaggccaaagggttgcacagaccaccgttctccatccaagacagccagccagctctacctgcacagccttgctgcctagcagagcactgggtctctgggctgcagtggcctggtctcagctagaagggatcattcttggcatagggtctttcttcctcactggggaagaatctatgatcacagaagaatctatggggagaatctatggggagaatctatgacccagaagaatctatgactgcagagatcagcagaagaggagtgggttttttttttcctcatttttattaacatatagttggtttacaatgttgtattagttttcctgtatagcaaagtgaatcagcaatatgtatacatatatcccccctttttcggatttccttcccatttaggtcaccacagcacactgagtagagctccctactccctactactaataagtagattctcattcagttcagttcagttcagtcactcagtcatgtctgactctttgcgaccccatggactgcagcatgctaggcctccctgtccatcaccaactcctggagttcactcaaactcatgttcattgagtcagtgataccatccaaccatctaatcctctgtcatccccttctcctcctgccttcaatctttcccaacatcagggtcttttccaacgagtcatttcttcgcatcaggtggccaaagtattggagtctcagcttcaacatcagtccctccaatgaacactcaggactgatctcctttaggatggactggattggatctccttgtagtccaagggactctcaagagtcttctccaacaccacagttcaaaagcatcaattctttggcgctcagccttcttcacagtccaactctcacatccatacctgactactggaaaaaccatagcgttgactagacagacctttgttagcaaagcaatggctctgcttttcaatatgctatctaggttggtcataactttccttccaagaagtaagcatcttttaatttcatggctgccagtcaccatctgcagtgattttggagcccagaagaataaagtctgacagtgtttccactgtttccccatctatttgccatgaactgatgggactggatgccatgatcttagttttctgaatgttgagctttaagccaactttttccactttcctctttcactttcatcgagaggctctttagttcttcttcactttctgccataagggtggcgtcatctgcatatctgatttctcccagcaatcttgattccagcttgtgcttcttccagcccagtgtttctcatgatgtactctgcattagttatctattttatacatagtatcaatagtgtatatacatcaatcccaatctcccaattcatcccccactctttccccttttggtgtccatacatttgttctctacatctgtgtctctatttccgttttatagatgagatcacctacaccattattttcagattccacacatatatgttaatatgcaatatttgtttttctgacttcactctgtatgacagcctctaggcccatactgtcatcattggctcaagtcagagatgacggagacaatgtggaagtcactagaactcttcaggcaggactcatactgactcagcagccagtgtatgttaggtaaggcacttgcatctagcaactccctgagtgcttacaaaagggcctctgctcccatgtacagatggggaatctgaggggcagaggcggcgtcacctacccagatcccctagctggctgactccagacaccagtacgtaaccactgggccatgcggcctctgtcaaagggcacatctcacaccctggaggagaggtttgcaaatgaggctgaaacactgctggcacatgaaagccactgtcccacatgcaggggcagcccagcccaggtggcagagagggctctcccaggtcacagctacatagagatggcagggggaggctgagagccatccaggcttttggcgtcttctggcagcacacatccctggggaccagctgaagctggggaacatgtcagtgttccaagaaatggcaggcacgaaggtgggacatggcctctgcaagttcagccctggggtggagagaggtcattctccatcttcatacagaaaacatggcctaagagggacagagaccaaaaagttccagaagagactgagcagggagaggggctgccagcggagacctgcctccacttcctgaatctctgaggccagggtgacaagtggtggcctcctgtgaaaggcccccgagccaactaggtccctcaccctccagctctagctatttgctgggtggaactgctggggaggagcatgctaggccctggtgctcaggacctcatggatgagggaaggaagaagggagtcagtgcttgaaaaaagtccatctggggaccttccctatactccactggccacactgcctgccccctgcaggttctgtttacagacctggccatttatttacttgctggggagcaaaaatgggaaaatgacagtgctgtcatgggaggacccggaggcaaatgacatgcccaaggccacacagggcagaggattctgacttgtcacaactgctgcttccaggaacacccagatgcgtagccccaaggcgtcacgctacactcaccggggctgccctggggagccgagcctgccctccaactctctggaagaacagggacccaggcacactgcccccggggcagatgactgcacttctctgcgcctctggttcttcaaacagcaatgccttccactcaaggctgttctcatcatccgacggcatcgaacttagatcaaagcatgacctggcacaaaaagcctctcaggcgcctcccctccgcccgaagtttccaaagacttctctaggcctctgcactccttcccaaggcacagctggacttgagacctcgttgtccagcacgagactcaggggaggaaaacaaaccaagaagccagcgtcaccccacttgtcagctggacagacccgcggtccagagaggggcagtgacttgggggaggcacacaagcaggcaggacttctcccataccagcttcatggagagaacaggccttggaccccacgtagtgtccccaggggaccctgggggtctcgctgtggctaagcggcctctcatcccacccaccggccctgcccccaggggttgccgtcctgtgacccacacagggcgctcgggctgccagggccttttagagtcagagccgctgagacttgggaagggggctggcctccctgaggtctcctggggtccccagcagggcagctaagacctgagtccccagcggcacgtggcggcgctgcccgatcggtgatgtcaggcccaccacacccgggccccagcacgttccttctcagagtcggcagagcagagaacaaagcgtcctgcgcattcttgcacgctgactcatcgcctgcacgtagagccacagcagctgctttgcccaaaattggtcgggaggcgggggcgcgccagacatggcagcctggggtcctctgctcactcacctgctccacactctccaggagcccccagtcccaggatttcccaaaacaggcaggaaagcaagaggcactggggggcatgctgttccccaggatagccagggctaccccctgggggagggctcgtgatcaggcacaggtggcaggctggggataaggcgtagatgcaggcactgcttgtctttgagcctcagtttcctcatctgcaaaatggggatgtgccagttaccattttaagcgtttgatatgagttcttttcccatattcttacaccaaccccaaatggaaatactgttatcatcatcatctcacaggtagggaaactaaggcacagacactgatttgcttgaggtcaggtgctagtgggcttccctggtggctcagtggtaaagaatctgcccacagtgtaggagaggcaggagacatgagttcagtttctgagtggggaggatcctctggaggagagcatggcaacccactccagtattcttgcctggagaatccatggacagagcgtctggtgggctacagtccatgggattgcaaagaattggacacgactgagcactcacccaggcacaagtgctagctagctgcagaggtaggatttaaatatgaattgtaaggttccagaatctgcatgtatcccctatatgctaaaatgcggattgaaatatctggtgcccagcaggtgttctcactgtgccctgacccttggtggttgagcctggtccctcacttcacctcactaaacctctaatccctcacctgtaaggtggggtaactgtgaaggatgccctcaagggattgtcagggaaattacactgaaggttcaagtgtgatctgtggaagaaaaggtagatttggttcaacaagccttcaaaccacctttggtcatctaggccaataccaaagtacagagaggagacgagctatgcctggggtcaccagccaggccaagccatactcgtctgggcctccccaggagtctggggaacacggagttgcctgtactctttgggaaagtgagggagcaggaggggccctgccatattccctctgccagcctggcctctcgcccccgacagcctgatttcagagaaggtggagttctttggatctgtcctgtgtcggggtcagaggcttgccctgagtttgtaggaatgaggtggccaccaggtggctttgttctcagctcttacccaggttgcggtgtcccccatctgaggcttgtctgatagtccagagaaagccctagaaggaattcagcacccctaccaccaccagcccccgagccaggcctggtctgggtcccagcgggtctgggccaccacggcacagatgcgcaggactccactctgtgcgctcagtcgctcagttgtgtctgactctgcaaccccatagactatacatagccaatcaggctcctctgtccatagaacttcccaggtaagaatactggagtgggatgccatttcctgctccagggtgtcttcccattccagagatcgaacccacggctcctgaatctcctgcatcaacaggaggattctctaccactgcgccacctgggaagactccactttaagctcaggaggaggtcagctcgggctgggtgtgcacggcctgtgcactggcctccaagctcctttcatccctgggtcctgcacactctttgctccagctcctagcacgtgccatgctcttccaggtctcccagcctttccccatcccatacctcttgcctggaatgccttctccaccttcagagcctcttttggatgcctcttctgctggaaagccatcctgacctttcaggaagaggcaggcactcattcctctggggtcctgtagctctttgtcctccctctttggccaacagaaagactgacacagaacacacactggcccttatcccatagacccccccccccgctgggtccatattccaagaaaaggccttcaagggccctccccccaaatcccaactgggacagagacccacagacccagcccaggtcttgcagagcaggctcagcctgtctactgcatgatggcaaaaggcacagcaaaggcgcctgaactcccatctcttctgctcctggctgtgtggccttgggcaacgcctgtagcttctctgaacttcttcattcccaggccttgccttgcccacttcccaggcccgtttggaagatcaaatgaatgaaggcagagagaatgcttggcgcgtgggcacagctccccacacagctgtcattatcaccgagtcattattacggacctgccttgtgcctggggggggcggtgcctccaaggctgggcagcaggcgggcaggcaggcgatgaactcagaagcagccgcagcctgggctgactcaggctgaggcactgggagaagtgggtgctttatggtcagcctgagccagcccagctctggccctctcctcctacccccaggcgtcacccaaatctgaggccacaaggccttccaggccctttcagggcctcttatctgggaagataaaggccccctccccttgaatggtggatctattcaaatggcttctgtgtgaccttggcaacagtcaccctctctggaccaggcttggggagttccggggtggggggcaggcagtgacctcaaaaggctcccagtgtgtcttccaggtgcttagtggggggactctcccactgctttgggccccagagggatggctcctgttctctccctccctgacactgacctgctgctgctgctaagtcgcttcagtcgtgtccgactctgtgcaaccccatagacggcagaccaccagactccgccatccctgggatcctccaggcaagaacactggagtgggttgccatttccttctccaatgcatgaaagtgaaaagtgaaagggaagtcgctcagtcgtatccaactcttcgcgaccccatggactgcagcccaccaggttcctccgtccatgggattttccaggcaagagtagtggagtggggtgccattgccttctccaggtgatggaactcccagtatcctccctagagtctggagttattatttttatctgacacataagaaaaatgaggcccagagatcaaaagaccctcacctaaggcagcacagtcaacagccaggacacaggcatgtgaccctgccagggtcttcagggcccacctactgcaatcctctattctcctgtggcctcctggctggcgacggctgcctctctctttccctccctggtggctcagagggtaaagaatcggcctgcaacacaggagacctgggttcaagatcccctggagaaggaaatggctactcactccagtattcttgcctggaaaattccatggacagaggagcctggtgagctacaatccatggaattgcaagagttggacatgaatgagctactaacactctttccctacaccctaggacaccagctctatgccaaggcttggacaacagtcaccaacttatgagatcttcacatgaatgtaagacagaggaggaagtcaaagctcagagagctggaattgcttggcctggtcacacagcacagtggtggctggaggctcagtctcccatacctctgctctgtgccctagaacagctgctaccccaggatggtaggggtttgaccaggcctcagggagcctgcagggcagccctctggtttcacagacaccccctggctatgggtgggccaaagaggaagggtacccatcctgccaggatggacctaccaggcccacctgggcccgacgctccttgccaggctcagatggaagcatgaggtcattgggccatccctgctccctgttggctctcgctgctgtgactcagccctgtcttccccaaacctccttctccagggaactctagcaatggtctggcctggccaggtctgctcccgctgcctgtccaccctctcagggcctcccagcctgagtcaccgctcacctcaccacctggcacaatgctcaccgcataaacagactattcccctcccccaggctcccagggttcctctccctacagcccaggagccaggctgaggggtgggggcacttttcctgctgtccccagacttcggccctgaggtccatccccagaacctactttcagggactctctggccttgataggaaaatctagaattgagattgaggcctcagcccagggctcagactgacctgggctcaaatcccagctccttccttgttaggtgggtgaccttgtacaagatacctccatttgaaggagggcaacagtaaaaccagctgcagcccatgaagatttcctacagcatcaccgaggccaggatcctgcttaaaaatgcaggtggctctagattcaaatggtggtatggcctcgcgtaagccactttgcctctctcagcctcagggtccttacctgcaaaatgggaacgagaggaagagagccctcctgctgtggtgactaaatgtgataagacatgaaaaaggtcaagccgtgtctggcacccagggaccaaacacgggtaaacgtttatgtggataaacggtagctgtaattaaatcttaaagtgacgtgtgcataacacatagctcgtgggaagctgccacatagcacagggagctcagctcagtgctctgtggtaacctagacagtgggatggagggggcaggcagagggagatccaaggaagaggggatatatgtatacatatagctgattcatttcactgtatagcagaaactagcataacattgtaaagcaattataccccaattaaaaaaaaaaaaagtgccaggcgttaagtgatcccaggatggttttaatgaatgatggggagatggagagcaatggtctggctcttcactggatgatggagtagcatcagggaacggcttcccaggttggaaagctccagcatcccctctgcaggttgaccaccccacttcccttagtgggtccagaaggctctctcaagagtctttctggctggggctggcctcacagttttccagtttccaggccactcaagaagcacttcactttacagaggacaaagctgatgctcagacaagggaaggggcttgtctgcagccacccagctggaagctgagcccaagcctgcacttccgtgttccccttcttcccagcctgggagctgcctccctggactggggataccctcacctcccagtctcagagagcactctgggagagtctcagagcttgtctgcacactggagactctttatctttgtctctatcttcccccgtaatgctcgagaggcagctccttgggccatggggccagtgaaagaggagaggacccaggagaaaacttctgtgacctcctcatttccagttcaacgggtgatgtgttgagcatgtgatctgaatgagggaacagaggctgggggaggtcgcatacgtaaagggtgaggggatagaaataacactgaccctggggtcaaacagacctgaattcaaaccccaaccattacacgtcaagctctctaacttctcagaatctgaagttgcatctgaaagcagatgccttgagatgcctcaaagggttatgctgcaaagatgaagtgagagcaagagtgtgaccaggctccgtaaatagggatgaaagtgaaagtgaagtcgctcagtcgtgtctgactctttgcgaccccatggactgtagcctaccaggcttctccgtccatgggattctccaggcaagaatactggagtgggttaccatttccttctccaggggatcttcccgacccagggatcgaacccaggtctcccgcattccaggcagatgctttaacctctgagccaccagggaagcccgtaaatagttatagtcagtaataatgatggctaccaccgatggagctcttcctcatttaatccttacacagccatgttactgtgattatacccattttacagatgagcaaactggagctcaaaaaaggaagaaagggcatatgtgatggggaagaaggggtctgacaccagaaccagagaccttagctactagccagccctcagagacataaaataaagcctagccagaggtggttatgggcgtgtgtgctaagttgattcagtcgtgtccgattctttgtgataccatgaactgtagcctgccaggctcctctgtccatgggattctccaggcaagaatactagagtgggttaccatgcccccctccaggggatctcctgacccagggaatcaaacctgcatctctatgtcacctgaattggcaggcaaattctttataccactagtgccatctgcaaaggtggctatggatgagaatattgtgggtgttcagaggtgagttagatctcatgtcttggatggagttgggaaggctggtccatggggtcacaaagaatcacacatgactgagcatgcacgcacgcacctgggggaggcaacctttttgatgggccttgagtttgggcaaaataaatcaagtaagaatggaaggaggaggaaaggcccaccttgcacagaagttgggaggcgagaaagtgtgcagtgtgttcaggaagtgacaagcctctgggaaaaggaaggaaagacaggtccaagtcaggtcccaagcaggccttatgccaggtgggcatttggactgaacaagatgcttcacgctgacaccaggccaggtcctggctccagaagcctggttttcataggaaggcaaattgacccaagtctcaatacccctcatgtctgttgtggcatcaggtactgtgccaaggcaaatgtgggtgagtggagcaagccaggctggccttgggcacctggagggactgtgtgacccagggcagtggaagggatgctcgtggtgcagctggcacatggtgtatagattcacacactttctactacatcccccccaacacacacatgcacacatcactcttttgcaggagtgtgtccacaccaagaggcccacacacaccctgcagcctgaggtgagggagggagagatagcagaggcctgctgaaagaaactcctgtgccaggcaatgggccaaagcgtccacgagctctgccacaaagcctccttgcggctatgaggtaggacttttcttcttaggagtctcggatggatgtgacctctgatactcaggaaaattaaacagtgctatacgcttggtcccaaggttggtgagcagcaaaatgaaagcacagactggctgcccctgccctgagctccgtagggcctgacacagtgctgggcactggggataagtggaggattggagtctgagtcacagggctttgaagctggcagccagagcagcggagcctcagagattccaggggtgggctggcccctgactcacccccacaccctgaggctgccccaggcagtggctttagctcctggccgccctcctgcctgccagagcccagcaaggcctcttctgagtctgtcatggctcaggattcccaggagctgggcgggcagggccaaagcctcaaggcaaggaggtatcctgggcacacctctgctcaggtatgtaggcctagagtcacagtgggaaccccggacctcaccagcctgatgtcagaggcaactaggcacttggggatagctgttaaatgaagaatgaaatactgtatttctgcatggcccagactccgggtggctcaccccttcccagagggaagacagccgcctggtgaggtgctgggtgcgccctggaaagtatgggttctaggcaacacggtgggtgtgactctgcaaaaccaccagctgcgtgtcttggctggtggtagtggagggaggagaaagctggggttccagcccctccaagtgcaggggcctcagagatgagaatccaggcattctggatctccaggatctctggtgggctgttccttctccctgtacctcagtttcctcatctaggtgtaggccaagggactttccctctctggctgcctgtcttttgcttttagaaattatgtccaagccttcatcgttagagcattttgaagatgtaatcaggcagaaaaggggacataagtcttcttcatcttaagcggtgtctctgcaagggcagttttgtctgatgagattaagtcatcttgtatattcactccagccttgggcctggaccatgtgcccaggcctgtgtgctaggccctggggttgggattgcaaagaagactgtgtctcagtgagttcataatttggggggagagacacctctcccccagaaataaccagatatttccaggacagtttaacatgcctttcaaagctctttgacctttccaatatctctaaccacatctgtcatgatggagaatagatgggtgagagattggttgtatagatatatggatggaaggatggataaaatgtcagataatggataaatggatggatcaatagaagggtggatggatggctgtggacatgggaggttgaatggatggatggagggagggatgaatgggtgagtaggtgaatagattgtgggggttgggggtgggaatcattgaatgtgtgatttaggttcctggtcccacagcagatgaatataaggggaaagttccagtcctgcctcttgttcattgtgtgaccctgaagaattcacttctttagctgtagagtgagaatctgtctggaaagacctcacctatcaagtgagagtcatgagcccagcctgcatcccaggtctgttgtgggtatccagtgaaagaggtatggactgcccatgcctacataatggctgtgatgagtcctcagtcagtggcctcacaggcaccggcaacgtgaggtgtttttgctgagggagtgacgcccctctgtggttgctggtgtgttcctaggcttcccacttcctccagcctgcacagagttctctgcccagttaggagcaaaggaggtgacctctgcagaagtgttgctgccagaggctccccatacgctgtacttgtcaaggagtaattgaggtgtcctgtttgttattcatctcagggtaagagtaggctcagcaagggggcacccagggcttgggattagggctttggagttacatagatctgccttccagccttggctctgccacttcctagctgcctgacattggacaaggcatgagcctcagtttccccatttataaaatagtaacaaattatagtacctaccccttaggtaggttatgacaattaataagcataacttatgtaaccacctaacatagagctcagaatatattaaatgcatgtgtatccaagtgcagaattgcgcccttagaactttgaagaaaagtccaaaacttcaagtctagagacctccatcttgaatgctcagtccttggattagtttccttatttcaaaatgttcagtgggactgacattcttcttgacaagtgtgccttgactgaacagtgtctggttttggctgcaattccaggagttccatgggcctcgctgaccctgtcctgattacccttaggttaatagcagactgggcacatgaattatccctttaaaagtggtttgtgtgggagctacaaatctttccaatgggctgagctgtagggaggaggagaatttagaagggggtgtcctcccggggaagccgcaaagaccaggagagctggtcccacaggaccgaggctactcttgcagagacccagtgtggggacgatgccgtgggcggtggcaggccctgctggctcagggtgagctgcagccgatggcaaggggcccagaccacccaccagaaagaggccctgagtctgagtggccctaggcttgagtgggggcagtcctgacctgtagccctgaggacataactcgggaacaggtcattatgggaatgtctaagctccctcagtcccgaaatccccaactcaggctggctccggggccataccctccccagacccccattccttgcagggtccagatatcccccttggccagccccatctgcccatctgctcgctctgctatatgcctgcatggtatgtgcctgcgactgagactctgtgtcccttccattgggactgcaatcaagagagcttcctgaaacctggtggggccaggtgacaacagggaagtggctggttttccagaaagtgaaagagcaaagggttccaggctgggagcaggagtgataacaatgaagtcacagagtctgcagagcttgcattttgggagctggaaactcagggcaggttgattctgcctgtcgtaggctatctgagctgagcaggcccctcacagtcgatgggaagagaggaaagctgtccagggaagccaaggaagggacaggacttgcccaaggccacacagcgtgaatagcaaagctggggacaaagctgcccactgctacaacatcgggtagctgctccagccctttcctgccctgttggacatcatcagaaggatgtttaatcctcgctcctgtacatcctccatcccatgccactggacagctattcgatgggaccaaatttatcattagtacaggggcaatcaaaggagctttggggtccccaggaaggtggcctaggcccatcccaatgtccctgccttcctgccagtgggatccttcctgacagcccttctcaaagggacccagtgcggctcagcttggacccctgggaactacactggtgtgcaggaaagggtgagtctggattagtagcccggagagtgtgtccagcccatcactgtcttgggcaagttgctcctcctcttggacctcagttatctcatctgcccaatgggagtgaaaaccagagagaatttctagaaggcagttcctagcatggtatatttcttcacccaaaaatacaccccaactatcctcttctgccagcccgccctccccacaaatctctgcttcttggattaggctggtgccaagtgtaagtgaagcaaattagtttgtgtgcaaatcaattcctccagcttctgacagggtgatctcctgtgaatccctgtgcctcagtctgcagcctttaccaacccaggcagggagcggggccaggtggggctgaggcagtgcagcagagcagctggtgggggcagtcagtaggaaccagagcaaaggagttgagggcccatgcagccaggtcagccaggaggcatagaggtgactgtcggggcccaggcctagagacctagggtggatattcttgttgttcttgttgtttcttagttgctaagtcatgtccaactcttttgtgaccccatggactgaagcccaccaggctcctccgtccatgggattctccaggtaagaatacaggagtgggttgccatttccttcttcaggagatcttcccaaaccagggatcgaacccacatctcctgcattggcaggcaggttctttaccactgagccatctgtgaagcccacgggccaggaactaaaggaaattcatgtgtgtattggaacagttggcttgtgcagacagaccatgatcatgtcaaaggcaagggaagagggaataaagaaaactgctgtttttaactcggcttgattttctctacctggaaaccaatcttgccagtgaggtggtgctgttcccggaacgctttcagccgctaagaccggggttcgctcaggttcccaggtccggcgtctccatttcacaggagccctgctcgcccggctggagcagcgggcagggaaggagggaaactggagttgggcgcagcctcccaagctgaccctgccaggccgggcggtggcccctgtcctgtcgtcatcctcctttcacagcagagagggatcctgtctcctggtctcgttaattcttctatcatgtttcccagactcggagcctctggttgcctattgtcctgagcaggcattttgcatttatgtaaagattagacaggttagaaccttcgctctcactccgatggtcttttttactttctcaaatccaagttctttccttctcactgcgctctgcttccttattctctctctctccctacctgtctttatcagcctccctgtttattttcttcccttccctgaccccctccttctccccactgacctgcttttcctctgtcctctcttcacagttcagtagtttgaatcctctttctcccccctccaccaccgccaccacaaccctaaccttgcttaattccatatttatcttctcccggagcctcatagaaatgactgaaagcattgctcacctcattccagaaataactcttctaaattcttagagaggcaccgcacgggggagggtgtgagcactggacagggagtcactgtggtttactggagagaacaagacccaggttcctctgtgggctcttgggtacaccagctgtgtgaccgtgacaccgctggcctctggccagtctctgtttcctcccaggcagcagtggagctggcacccagatgagaacagctgtgtgtaaggttgtgaaggagagaggacggtggtgccctgcacacacacttgtgctctgaaatgtttttcctgcttccaccgcagcctgagccagtcggagggaaggaaggggatgctaactggtatctccctccttggttctgctctgctctacagggatcacacatgcgcgcacacacgaacatgccctgggaagaaacaaagctgtttcttcaccgtcatctatttctcccttccaaaatgtctaatggtaaaatcccaactgaacacaggagcaaaaacttgggctttagtgggttcctgaatttctccatttcaaatccaggccttcattcattcaccgccccctccctcggacagcactcactcagagtctcctactgtgtgccagacgggctccagggctggccttctctggagctctggacctcgagattgttggggagataagcccaatgtcatgagtcaggcatgagagagagcacgggttctgggagttccaagaaatgagagggcctttcctcttgtgcctggagacagggtccctgagaaggagggactctgagccagccgaggggcaggagcaggatgctggcccccagggagcccctccatcactctgccttttttgcagaaagtcacagaggtgagccaagacatcctgtcctggccaagatgggaggttttcccaggggcttttggtgtacatatccacaagccacctttctggaaagggctctgagggccccttcttagcatcaaggaaatctgtgggtcacataggttaagaagaaggaaagaagggcacttcctgggggaggtggggaggaggcggctccaggctggtcagtggtcaggggtaaactgtgtccttccctaaggaaagcaggcccagagaaggctctgactctcccaagtccacacagccttgtaggtcatttacctcccacgcagcagaagggacaccctccacctggttgacagtaggcagacaggaaagcagggtctcctccaaggaaagggagggttttgcccatgggacctctccctcccaactctgagctctgggcaagacccatggagagtggggaggggctcacggcatttggaggatgacttgagggggtccagtgggactgaaaggggtccctggggacagcacgggagcctcaggactccaggaggtgctccaggctcagagggagcatcctcccccctttttcctccctcatcctgccctcctccctaccgcagaggctggggcgggccgggcgccctgggaggaggcggtgtccctggctccctgcccaccggtgcagggctggacgggcaggggcggagccatgcctggtgttataagaggcagccagggcaccgaggcaatgagctgtcgctcagcttggcagcaggacgctggcagcaggcacactccgcactccagcccagcctgagcgtgcctcaccactgtggtcgccatgcccaccgccttgtgctccatcgctctagccctgctcgtggccctgcacgaaggtgagcaccccccacgggctcagcagctgcagcagccccgaggctgcttgtctgtatctcctgctggggctctgtgccccccaagccagccgggggccttcaggggcaggagttaggtggcttgggggctgcaggaggctgtgctattagaggtgctgccgtcccaggacagccaccggtccttccaacccagagctgctggggcttccccaggctggcccagggctcctgagcactgagaatgccaacttcctcgattatgcaagaggaggagcccagcgggtcccccatcccagctgtgccaggcgccctgacccacctctccacttttctctccctcctgtgcatgcaggcaagagccaggctgctaccacccccatcccagagcaaccagcgcccttgccccgggcccgaggctcccacctgcggactcgacgttgctcctgcagctcctggctcgacaaggagtgcgtctacttttgccacctggacattatctgggtgaacactcccgggtgagctactggagggatccaagaggggttgcagggggcaggggtggggaatgctggcatgctggggaagccctggcacactgcagctctctcttggagtgtggggctaacaacaatagcaatcagctattgcttcagttctcacgtgggggctgcctgagcaagacagagggctgtctcatgaaaatcctcacaaaaagcctggtcagaaagtgttggctccattttccagatcagggtactgaggctcagagaagttaggtgccttttccaaggtcacacaggaagagtaagtggtaggtaggaggctccagcctaggtctgcagatgccagagcgcacagcggctctgccatgctgcctctgtataatcttccaagaatgatatgattaatgacagcacccatgtcttgactgcgccaggccctatgccaagcactgctggtgcgttatcacctcgtgaacgcacccccatcctccccagtgaagcggggactgctgctgtccccaaatgacagacaagagacctgccccatgtcacctggcagagccggggtggggtcccagagctgtctgttctgtctgcacccgcgctgcctccgggccactgcatacttcaagttgaagtttctctgtgtgtttgtattttttttttccttctccaaattgcaaaagacaagagaagcccggcacgtaagcgtgtgtggagctaatccgcatccaaacactggctcagggcgggaaccctgccagtccctgcgtgctgggtctacctggagtctctgcagctccaaccacaccgtctaaaattagctcaggcatccgaggtgctggtctgaccggccacggggccctgcccttcgcctggcccgtctcagccagacggaatctgaaatcgatctcagccaatctaatatatctatgcacacacacgcacacgtgcaggtcaggcacacgcaccattttaaagtcaaaactctaagaaacacttgggtcacccttccaggcaagtggtgaccggatggaggcagctgagctgtgagcctgagtgttcacttctgtgagagggcactctctccctttcttccagactagttgggggtcttctttgagaacagggggaccagcctgactccatcagttcaaattgctgtctgggagtgagaggggcagggaggacagcttccacccctcccccccatgctgagcgtcttactgagcaggaccagggcagttgggagggaacagaggcccgagagggtaagggtcttgcccgaggctccctggcatgtaaggaggaagctgcagtgggaattcttgagggcaggagctggttacttttgctgccaccctggtggcatggatggctatcccagtgtgcagtgtggacagtcccagcttgccaatggtcctggtttatctaatcctctctctgtctctctccaccctacaccactaccttgctggcggcccgcccacagacagacagctccttacggcctgggaaacccgccaagacgccggcgccgctctctgccaagacgctgtgagtgctacagtgccagggaccccgcctgtgccaccttctgccatcaaaggccctggtaagtgggcacccagcctgcaaggggccagaggtgactgctggcctggacctgctctggagggcagggtgtctggaaggccagcagtggcggactgttagtccctaggtcgtgcccgactgtttgtgaccccacggactgtagcctgccaggctcctctgtctatgggattctccaggcaagaataccggagtgaattgccattcccttctccagggtgtccaggaggccagcagaggcgtggctaaatggtggaggaggggccaggggagcagggtcctgggggtccagaggctgccctgggctgtggggcagcctcccttcctgcagggagccagtcacccttgagtcttcccccctgccactacccccagctctgggggcttctgagaccattgcgtccccactcctgggcaggaggaatcctccccaggtgatagctgaggcagcacaggtccagagaggaaacaggacttgtcctgtcaggctacacagccagttagacgagagctgggccttccgccttagtcgctggggctctgggacctctggaactttctcagtggagaagcagtagctggagttggggggccatggcaccgtccccgagctgccacaaagcgcctttgccagtcttttggccctctggacctccctccctccacgcggagcgttgggaaagcagacagtgacttcaccctcccctacctcccgctctcatgaaggcctatgggaaactcctcccctgagacctcagctgtggctgcagccctgcctcagtttccctgctgagggttctgcttggctgcaagtggccagactctgggaaggccagccaccccactgcctctttctgaggctgagaacgcattcccagtggctcagttttcctcaggccccaccccacctgggaaaagaagggtgccaggtgcacagggtggaaatggatctgctcctgagggcgggtcggggcggggggctgggctgggcctgcagccaggcagcctgggggccctggacagcccctcacttgggccctaatgctgttcactcaggactgatgcggtggcagtcccaggcagcgggtcccctgcagctgcgttccaggatggcaagacacaggccacagcaggagagctcctccagcggctgaggtgaggggcccctacactgattgagtgccttctgtatgccttgcacatttcccttattctccatatgacgccttgggtccttatggggcagccaatagcagctcagacagatgaaggtgtttacccaaggtcacagagcaagctacagcatctggctgactcaatagcctgtgttcttaaccactatgctctttgttaccgccaggcctggaagtggacttttattgagggtttcaaggcttgtgactgtggaaggttcccaggtgttcattcaggctgtgtctgaatcaagcatctcccacatgctggggtccaaacggatgctacccagcctgttccctccctgggtcccagactggactgtctccctggtagctacaacatggctcagctcaaggcttggcatccaggaggtgcccatgaacgtgtgtccaaccaaactgacttgagaacagaaacctatagccagtcatgtggcagggtggctgaaggggcagcatctgagctagaaagtcccagccctgccacgagcaagctttgtgaccttggtctgctcactgaacttctctgtgcttctggttcctgtctgtgaggcagggacaccgctgctatccatctcacgggcttgttgaagtttagagcagttgacatacatgaagagccccaagaaagcccaggccctacgggagctctgaaggttttagccatcccgaacctctgtccctgagggttcctcagggctgcccagggccggggtgcagcctagcccctcaagggtccacatctctgtgaggaggcggaaacataggcaaaaagacaggatggccggctaggcaggacccaggatatactgaggaactatcttaaaaaaataataataaaatgaaagtgttagtcactcagtcgtgtctgactctttgcaaccccatggactatagctcaccagactcctctgtccatggaattctccaggcaagaatactggagtgggtagccattcctttctccagaaaatcttcccaacccagggatcaaacctgggtgccccgcattgcaggcagattctttatcatctgagccactagggaaacccaggaaatgtcttaagatgaaaaacttcaaggtaagactttgcaagtacttggcattccataattagcaaagagtgttttcgccagtctgtactcagcctcacaccagttcaggcctgtgtttattttacagaccaagaagggggttcagagaggttgagacccttgcccaagttcccaaagctgggaaccagcctcccagttcccaggctagaacgccttaagccagagtgaggccacctagatgacggcagagcccctaccagggtctcagccagattcaaaggactgctaggatccatacatatctggagctggaccttgaagaatgggaattttagggcacggagtatggggtgagtggaaggtcaacagcctgaagagccacagggatagaggtgtggaagtgagagggcaatcaggggagagccacggggctactcttggccgtgcagtcaccctggtggcacttgatgttgagcatcaattttgtcaaagctccttgtgggcagaaaagcttctaacctgccccggcctctccttgaggttcagaccttgttttcagggttggctgtgaccaccctctgacctcttggccatgaataaggaatccagaccctatgaccgctgcctctcatggggaactctcaagtgatgtatatctccagagatgctcaattgacctctttccatttcagggttatttctgcaaccaagatccactttgctaggcaacagcagaagccgacgagggagaccagacctacacactccaggcagaggaagagatagctctcgactctgggagaactttgggaaggaagcctgtgtggatacaggaggagaggggcatcccagagctgggagaccttccgacctgtttcctgggccagaaaacccagctgctggagcaggcacaagctctggcctcctcgccctggggagggggcctcgctcaaggcagctccgtgacaccaggaaagtcatcaggccccaggctgcagcgtggcctcccacactggctccagttcctaggccctgctgaaaggaacggcatgcggaatgtgctagcctggaggtgtcctgtctggcggctgtgaaccaggaacaacgtgcagtggcgggcactcacacccaagccagcccgagtccttccagggttgaagtcccggccgcccccgacccctcacccccgctctgtcccctccagccctcgctctccagtgtccttattctcccttcataccctcggggcactcttggtgagaagggcctgcaccacttcacctgtctgtatataacttatttgctctaagaaatttgacgattccgattatttattttaacgtatttttttagactctcaattatttacctgcgaacttgtgtttgtaataaacaacaaaataatgctctagcatttggtcttggttgagcaggaggtgggaggcacttttcaggaaggggctacttagaagtgaagggaacaaagggacggcggggaaagagcctgaggcaggtgtggagcactgagttccacacccctgtgccccggctgggcatcgctggctgctgacccaccctctctggacttttgcctatcatgtgcctagacagccatttgcagctttgatatcccgggttccaggacctgtgtttctatcaggccggtaagtgttggccaggcctttccccagagcatgtttcataggagccaagactataaggacccacttctgctctggttgccacccctgaggttcagagcaaacctgtccagtgagggctgtgtgctgttccaagactgtgtgcagccttactggccagggatggctgttgtaacggagtcacaggctggtccttatccctcaccctgggcttggacagaccccgctgggggcgctcaacacttctctcactaaagaagcccagggctctagcactggcttggctgatcctgccaaggccccaggaagctgctcacctgagtcccagggacagccagaagctacccccgctggcagctcctgagacctacagcctccactgctgccaaatccccctgcgaacaaactgttccctttcccctggccggcctctgctgggaatggtacgctgtggcctgagccagttattgaaaaataattatttacacactactctaagcctgccttgtccatggagccagccccaactccctcctgggagaagaacatgttgacgcatattgaactcctactgtttgctggcattttatgcagataaactcacttcatcctcatgacaatcccatgatatagatacttttattatccccattttacagatgaggaaactaatgcacagagaaggcaactaattttcctggggtctcgcagcaagtaagtggtagcatcaggatttgaacccagagtgtatagtacacatgtctatatgtactgactaaatatttgttgattgaattcatggattaccactgtagtatgacattgaacaaatcttcctctttctgagcctcagttttttaatctataaaatgggaaacagtactttccactttgtagagctggttgtgaaccctaaatggatgagttatggtgctgggctcagtcctgggcctgatgagaggcaaagccgaatgtcaggccgttagaagtgatgatgtaacaagagggacaggcacaaagctgcaggacctaagttggggggagattggggctggctggtgtgcagaggcatggtcagagaaagatgcacgactaaggtgccactcccacagcctaaggagagtgagactcacatcaatagaaggaaagtgaagagggagccccagacagagcagacaggaagggtaaaaggttttggcaatgggagtgacaaaggggtttcccatggaggaccccatgtggctggagcatggtggggagagagcagcaggagaggaaaccaggactccctggaggccaaagtagggagcctgcactttctctcatgggccatggggaccctcgaaaggtctgtgggcagcagggacctggtaaagccagactttgaaaaaatgccagagggccacacagggggaccctgaatggggagacagaaggcagggaagcaagtcaaccgctggtccttagggatccagcctgggtggctggggttggcgatggagccacacagtcacttcctacccaggattccggcacacctctgaaatctcactgagcctaacgccaggtgaatctcactccccagcatcctgttcaaaataaccctgcccccacggaaatcccaaagcaacggccaacagtcaggctaggcagtgatgtggggcaaccccagcatggcaggagtgatcgagaccaggtagaggaatgtaggttgaaggtgtgtccgaggcccagggaattaggcattcactgccctggtcagagttcagagatcagcgaccaaatgattaagtaagagacaattagagggaggcccagaaggcaggtgaaggcaaggcgataccataacccccaggatccttactctcaagaaatgggggcccctggcttgggccctgcactctagccctctgccagccatatctttctctccaaataagaagtttgcagggtgaagggtcatgaatacccaaagtctgagcctgcttctaaaccacattccatgcagcaggggcctcagaagtgtgggggaaggtgggatagagtttggaagaagcagaggaaaatttatgaagaactgttgccaaatcaaactgaaccctgggaagaaaggtgtcaacattttagaaagcatatctggattttatgggacaaaatcgtccctttttcctgcctttttctgccttttccataaatacttacaggtttggtttaggctttctgagttaaacttgtgttccttttaactggaacaccaggcggagataggccagaagggggcacagggtgacccagatttattcgggtcatgtgcatgcatggaagcagagtcagaggggagtggagttccatgtccaggactgtgcagcctgatacatatccaggctacagactggccctttcctgtcctggactgcctctccctccactctctcattcagcaaagaaccccaaggaactagtttcactcttgccatctcactctctctctgaacctcagggatttcaattgagaaaagtcatttgcctatcagggcaatgaatcattggagtgtggccatccatgcgttcaacaattatgaacaatcaccgttcagagactcccgtaaacaaggcagacacagcccctgccctcacaggccaagaggagagcctttcaataaagcactgttactatgaaggtagaagtgaaagcatttattgagtgctcatcaagctcttcttgcacatggattctttggatccttgcagcaaccttacacagcaggttctatcatcgctattcccagttgagagaagagataacggaggttaagcagctcacccaaagtctcatggctagcatgtggctgagctgggatttaaatctcaggctctcagcctgtctgctgtcctgctgctctaagcaggtagatccatacatagtgtgattgagcccctcgggtgggagagtctgggaggcttcctggaggaagtgacagttgatcaagagaaggagcgggtggacagagtgttcaggcagggggaacagtgtgtaggaagggagctatattctctgtgcttagtcattcaatcctatttgggacctcttggtctatagtccgttaggctcctctgtccatgggattctccaggcaagaatactggagtgggtagccatgccctcctccaggggatcttcccaacccagcgattgaacccaggtctcctgcattgcaggtggattctttaccagctgagctacccaggaagcccattctcagaccctatcagggaacaaaagaaggaggcatggggaagactggagaggggttgctagcggggtcgggggggtggtgggcatgcggctacaagcagggaaatccacagctgctgtcacctcacccccaatctgtgacagcctcagacaatgtccccctggacaatattgccatgcctgaaacacacctttggatcaaaccgtgcttgcgccccttggggtttccctaggctggcaaggaagacagacaaggcaaagtgaagagacaggaggtggataggttacgggctgcccttccagctgtgtgcccttcctgtctccctgggatctctgctcatttcatcccaggggcgttgtgggttcacagggaaagcttggggaaggagtagggtttgcacacactgggatgagggaaacagccggagcatagaagaatccgaaaagaggcagcaagcctgattggcaagggccaggctgggaacagcatgcagtgccaggaatttgaacttgagtgacggggagccagcgaaggtggctgatcaggggagagagccaggacaggagctggccttgggcagctggcttgtcctcggctcttcctgcctccccggccagtgcttccagctcaagggggccctcccagcccctcgcaggagagacaaagtgtgggccttgcctccgcctgccagggaccggagccaagagccctcagcagctcggaagggggccatgtgcgggcccgccaggagccctggaagaggaatgtggcctaattaattctccaaagctcagagggcctcgccttgtgggagcagctgccaggacaggcctgccaggacgccacaggcccagcccgtctatcattcagtgctcggggacagcaggctggaagcctggagacaggggcccagggggccagccccttgcctccaggtacacacgtgtcctccagccccttaacagaaaatagtgcgataatagtaataatcgccaacaggccttgagggcttaaaggtgtgtcagactctgtgcaaagcctgttatactcacttctcatctattcattacgaaggaccagtgacagggaaactgttaccatctccattttgcagatgaggaaactgagggacagatgggtgaatttccctggccgaaatcctgcaatcaaaaagcacacgcagggaagctaggattgggatgtaggcagcctgggccccacaagcatgttgtcataagcactgctgagccagcccagcgaggacatggaggcccagggtggagcgatacctttcccggggacagtcgactaaaaacaggccctgggacattgaatagggaagaaagaccacacccctgtcctctgcttgaactgcctcctcctgaagtttctcatagggcttttcctgtctcagcccgtaggtcatcctcaaagacatgtgactcgctactccaggcagatgggctggaagaagacatgccgtctccctgggatccctgctcatttcatcccggtggcgctgtggtggctgcactggcagctgggcgaggtggtctcacagcttcctcctagcccgctttccatccgtccacggaacacatcccctccaaggcgggctctgaatggtgcagggacggctgtaccagggccttccaactagaaagtggcagacccaggagaagatgggcacacagactggcccgaagccaagactctgctcttcctcagcagcagagcaggaggagggcagtgcagccacatcgcatcccctctctgggcctcagtttctcatctgctgtatgggcctaagagcattaactgtatagtcttgtcctgcattcatgcaggctaagttgcttcagtcatgtccgactctgtgcgatcctgtggactgtagctccccaggctcctcaatccatgggattctccaggcaagaatactggagtgggttgccatttccttctccagggggtcttcccagcccggggatggaacacatgtttcttacatcttctgcgttggaaggcaggttctctaccactagggccacctgagaagccccatagtcatgtcctggaactcattcatgtgtcaagtactgtccgaagtagtttacttaatttttaaaaattttccaaagcaaggttttttcatagctttgtaacatatcaccataaggctgcaccatatgcatctgttactctgtaggtgtgtattttagtttgtcccatttccctccaatgcaatgtttacatgtgtgctacatttatacacaaattttatattcattcctaattcttttttgctgcatattttttatggagacataatttacaccccataaaatccactcttttaaagtgtacaattcagggtttttttttaaatatattcacagttatacaaccatcaccactatctaattccagaacgtttccatcatcccaaaaagaaacacctcacctgttagcagttgctccccagatctcacttccccggcctctgtacaccacaaatctactttctgtcactatggatttgcctgttctggacattttatatcaatggaatcataacgtacgtggccttttgtgtactgctccgttcacttagcacaatgtcctcaagatttgtctatgttggagcaggtgtcgatacttcacgcttttccatgactgaataatattcccttatagagacagatcaggcttcccgggtggctcagtggttgagaatccccctgacaatgcaggagatgcaggagatgtgggtttgatccctgggtcgggaaaaacccctggagaaggaaatggcaacccactccagtattcttgtctgggaaatctcatgaacagaggagcctggcaggctacagtccatggggttacaaagagttgaacatgacttacaactgaacacacacacacacacagatcacattttgtttatccatttgtctgcgttgtttccactcttttggcttaagcactttactttagccttcagtgaccctatggggaggtgctctcttttcatcatataaacaacaagactgacatccagagagcttaagtaacccatgcaggtcacttagctagtgagcggcggtggtgggctttgccccaagagtctggctgcagagacagtggcctcaaccactgagcatcactttctcttcagtcagagtaagatagtataaatcagcacccacagcaactgtgccaaaagtggtacccacagggcacttaacagagggtggcttttctcagcagcatttctgacactggcagagccagggtctgccaggcagggcctgaagctggagcaagagtgtctggacagccagtgataatagtgactatctcagtacacgggtggttcttccagcaatggggacatctctccacacttggtggggggccgtgggcactgactcctctgctgcacatctctggcctgcaccccagagcccatctctcctcccacctccacctacaaagtcatggctcccctcctgtccccaaggccctgacactgagtaaccgaggcagcattcttgggtgaggtcaaggtcagagctgcagtggaggctgcatggacccttgaatgggtctctgtctcctcaggcctccacctactaaataattagataagaaatcttaatacttccttttttaattacaaagcaatttaaataggacaatatagacacaaaggcttgtggctttaagataatgaaaagactataggaacatctaaaataaaatgtctcttctgggcctcccactccaaggcaacgactctgagagtggggtaaatagccttttttttttctatgggttcagatatatgttttctatctaacgttttagaggtattaaaaataatgcacggcaacataagtttctctactttacaaccttttcttctcacaccaaaggcatctttccagaccaatacaaggcttttaccacctcttaattttaacagctccacgtggcccttgttaaggacaggcagttgtcacttgactgtccacccactgaagccttttggatggcttgcatttcttgttttcataagcacactacagtaagcacctggtttatacatctttgtctgcagaggacagatttttagacacgaaatttctaggtcaaaggatgagcacattttaagtattctgccgagaatgagattccaatttgcattcttgttcccactgggtatgagtgcccttttcctcacaagccttccagcactgggttttatccatctcttatcgtttgctgccctggtagcaaaaccacttcttcataaggaatacgatgtgcaaaagagctttgcttgatgccacccagggtgaggagggtgaggggtctggagatgctccaatgtctcactctgtcccctggtgcaaagaactcctctagggacttccagcactgctctccaggattctgtttggctctagggctctgtctctcagttccactcaggggttggccctcagggagctaagaatggaggaggggctggccagtcttcctgctcagttggccccagcctcccctaatagatgtgtctttgagtaggcgctcctggggacagcatcatcatgggaaagcgtgtgtgcgtgttgggagcggggggactctgggcacctgaacctgcagatgttcctaatgggggagcctggggcatcctggttccctctcagcctgccatccaaactcacgttttggaaaagactgaatctggatcttgcctctgcccaggtcttgctgtgtagacccaggcaggtcactgtcctttctggactccaggctcccggctgccaggctgggggaatccctttacagggtagatgccgaatctgctccctctggagactccacactggccacaccatgcgcatgagtcacccccaagttggcaggctgagggcaggggaggggcatggaggcaagagaagggaggctcgctccagatgactttggtgccacatggtgagtctggcgcagtggagtcttgcctggctaacgtgagtgtgtgagcacaggcacacagggcacaccgacgtgtgaagtgcattcttgtataccgaccggggatcctcctgctcaagtctgggcattcaggtttacagctcaggtgatgagtgtccatacacaatccatgtgtgtgcacattcttgtgcgtgtcaacacatacacgcatgtgtgcctgagtgcccctgagcttgtaaatcttcacctggttgtggctgcctagatgtgtctgcatgaacgtgtgaaagtgttagttgctcagtcatgtctgactctcctctgtccatgggatttcccaggcaagaatattggagtgggctctctggggcattttcccgacccagggatcgaacccttgtctcctgcattgtaggtggattctttactatctgagccaccagggaagcccagatgtgtgtgcacacatgtgcctaaatccgtgtgcatgcgtgagggtgcaggtgagcctgcaggatgtgcgcacacgtctatgattagagattacgggtgtgtgggtgcacaagtgtcacaaacatacacactaatgtgtgcgtttgtgtctgagcacatgtcaaaacacatgcatagagtatccgtagtgtagatggagtgcgtccacatgtatgggtctagaagggcttcagtgtgcatatgggcacagctatgtatgaactattacagtgtaactctgttgaagtgaatacacatgagtgtacatttgcacccaggaggggccacctcagcgtctgcaaactatgacatctcctccagggcccatcccacctggcctggacctctcccctcaacccacactgaggaaccaacagaaggacagtgtcattgctttaattacaggaagactaagtattttagtaattagtaagtcattataaagcttactgcttttaagaacaaaaatggctatattatagatacaaaatgcatatggaatctgaacaagaagcatggaagtgcaggattttccaccccaatctgggtgggagggcttgaagaccaagtatacacagggctcaggaaggcaagggagggagaggccagagcagagagcccctgcctccatttccaaggctgtccacacctgacctccatccctacctccatccagcgagatatcgttctgggcccagagggccccaaccctggcctgagtggaagtcagggagtgagtgtgtcagaccacctctgacagcaaccagtcaaggcaaggcccttctcattctcccttccgtggcctataactctaagatagtcatacctacctgggttttctcaaagaacctcaaaatataacctccaacacgtgcctacctccttcatcctcccagaacaatttctacctcccacccccagctcctgtccttctctcttggcctgcactgcctccttgccacaggtctgacccacaaacttctactcattggtccaaaaccacgcctgtgtcaccacccagctgtacaattgtcatcccagctggactgtgaactcctgaggtagggaaggctcaggcattcttgggtccccagagcccacctcaacctggcacagcttagatatcactcactatctgattttagaaactgagataagaggagaagaaagggagagcccctgggcgcagcaacgtttggtaaacacggcaggtcgttgggtgccccaagactggatgagtcagcctgacccttgccctggaggaggaagaaaaagtgtcatttatcaggctccacctggtgccagcatcagccacacacttgatccccaccacacacctgagaagtaagcaatatttttactcccattttatagatgcagaaactgaccctcacagaaagtgagtcagcagcagagctgggactcaagccttcctgactcagcacttcctacaggctcatccccccaggttctttctctctgnnnnnnnnnnnnnnnnnnnnnnnnnnnnnnnnnnnnnnnnnnnnnnnnnntcctcaggaacagcccttaatcataaaggattggggtggtgggtagatacgccagctcacttgcaccatgggtggagcaactctaaggctgcttccacaccctctcccggaggtctctggaggggctaagccctgtttccacctgttgctcattaacttgtctgtattggctgcgcttcctttctcccttccacatcttttatggatcttagaaccacctcgaaaataaactccatgccctcgaatcttagtccaggtcctctctggggaccccaacccaagaccaaggggcagcagccacagggactgtgagtctgggaaagccagggggacattcttgcaaagaggcctcggccacagaggcccagagacacatgcaggtccagacccatgggatgagccctggcaggcgggaggccagcctgactgcagctccagagctgcacacagtgtcaggctggcgcatgaggacgcaggagcaccagggtaaagagggcacgggtgtgagcacagcagctgatggcaacggggtttatctcagggcccaagaccacacccacacctccctcccttctgcagaaatgggcctggaacacctgtgccctggcaagccctagggtagaccccggctggaaaaccccagggctcccagctggccttctactgctcagcacctctggcctgggtcctggcagagcagggaggctgcctggggaaggtcttagatggcaaatctgtacaattctgtgcctctctgtccttcccattcaagaaatggcacagggccttggtagggccgaggaagtgaatggagggatcccagcacctcagagggcccctgttctctgactctgccaggacatagtttgcacacagaacattagatgtggcatatcttgcttccccacgcttttcagaagagggtgggcttccctgatggcactagtgttaaagaacctgactgccagtgcaggagatgtaagagatgtgggttcaatccttggatcaggaagatcccctggaggaggacatggcattccggtactcttgcctggagaatcccatgaacagaggagcctggtgggctacaggccatggcatcgcgaagagtcagacacgactgaagtgacttagtatgcacgcacattacttaacccagaggaatcaagttctaacggtggaaattcaagcattggaaaagacatggcttgattttaggagttggccttccctcaaatcacaccatgtcaaatctcagacaggcagcatcatgaagcagaaaaggcacaggctgtagagccagacagacctggctcaaatccttggagacagaaaagcccctcatcctgagctttggcttccttggctgtgaaataagttgacagtgtccactggcgggagacctggcttcagtccctgggttgggaagatcccctggagaaggaaaaggctagccactccagtattctggcctggagaatcccatggactgtatagtccatgaggttgcaaagagttggcactactgagcgactttcgctttcactttcactggccccaggtaagcatcttcaatctccttcagtcctcagtctggtgaggaagtaactccagagatgagcagatgggcactaaggcggccaactcctgctcaggtgggtccagagtgattcagaagcctgctgccccctgccaggggcctctgaggctgggctgtgccctgtccacttcaccctccccctgtgtggcccagccctgacccgagactcacccactgcccggtttcggcacctggcccacagttagccagggctgggtcttcagtatcaacattcctctgggataaatacctttggcctcaggaatgctgggaactgggccaagaggtcaaagggcctggactttatcctgagaagctcttaaagcctcacagcacctagacgaggcaggcgtagcccagtcataaagagaaactgagagccactgatttcatccaagaaaagaaaccaggggcctccttggttatcctccataagaatcaggacagcagaagatgaaaaaaatggactcaaagcaagcaacagactggaaattccacttctgggtatttaccccaaaggagtgcctagatatgttcatctgaagatacatacaaggttgttcacagcagcattgtttataatagtctcatactaagtgaagtaagccacaaacagaaagacaaatatatgattttccttatatggggtataagtgataccccatatatcgcttatacaaatgataaaaatgaacttatttgatgaaaaaaatgatacaaatgaacttctttgcaaaaccgaaacagactcacagagaacaaactatggtcactggagggaggagttggacatcagcatgtacacactgccgtgtttaaaataaataaccaacagggacctggtgtatagcacaaagaattctgctcaatacagtaataacctaaatgagaaaagaatttgagaaagaatagatgtatatatatgggcaactaaatcactttgctttacatttcaaactaacacaacattgttaaataactataggtaggtaggtagatttagttgctaagtggtgaccgaatcttgcctgccaggttcctctgtccatgggattctccaggcaagaatactggagtgggttgccatttccttctccagggatcttcccgacccaagaattgaacctgagtctcctgcactgcagtcagattctttatcaactgtgctatgagggaagaaaactccttaatgtaattaactatagttaacataattagtgagtgaagtgaaaattgctcagtcacgtctgactctttgcaactccgtggactatacagtccatgaaattctccaggcaagaatactggagtgggtagcctttcctttctccaagggatcttcccttaactagaagttaattaactaattagaagtaaatataattaactatactccaatataaaatttaaatatatactagaatgttcatagcagcactgtttataatagtctcaaactggaaactatgcaaaagggcagcaacagtagaatgaataagtaaattgatccctggtggctcagatggtaaagaatctgcctgcaatgcaggagacctggattcaatccttgggtcaggaagatcccctggagaggggaagggcaacaaactccagtatttttgcatggagaattccacagacagaggagcctggtggggtccttggggtcaaaaagagttggatacaactgagcaactaacactttctttcttcagattgaactacaactgataaaatcatacggatgatcttacaaatgaaacaagattccatcctttaagattccgtatgtctatatctatatccatgtatatctatatatctccagttttagtggtgccagaactcagcaaagtgatttcccttgggggaatgagggcaggcagtgactgaaagggaactggaagggagcctttggagaagcagtcatgttccattttttgatatagcttcagggtgcatgggtgttcttgttttgggaaaatccttcaagttgtacatttatgatctgtacacttttctatatgaatactatgctcttgaatcttgtgttggaatcttagcgatatgccctcttctacgtatggcctcttttgtgcaacattgtatttttgacattcatccatgttgtgacatgtaacaagatttcttctttttcactgccatgtagtattctattacccgaatagaccacaatgtgttcatccattctactgttgatggaaggtgggttgtttatggtctaggagctattacaaattagtgctgctttgaccattttttgtacctgagttttgatgaataaatgtacatatttctgctaggggtatacctaggggcgggatggctagctcatagaatatatacatcttcagctaacggcaccccactccagtactcttgcctggaaaatcccatggatggaggagcctggtaggctgcattccatggggttgctaagagtcggacacgactgagcaacttcactttcacttttcactttcatgcattggaggaagaaatggcaacctactccagtgttcttgcctggagaatcccagggacagtggggcctggtgggctgcagtctatggggtcgcacagagtcggacacgactgaagcgacttagcagcagcagtaatgctttggaaggaatggtgctaaagctgaaactccagtattttgggcacttcatgagaagagttgactcattggaaaagactctgatgctgggagagattgggggcaggaggagaaggggacgactgaggatgagatggctggatggcatcaccgactcgatggacgtgagtttgagtgaactcagggagttggtgatggacagggaggcctggtgtgctgcgattcatggggtctcaaagagtcggacacaactgagtgactgaactgaattgaactgaactgaatgattttccaaaatgttttaccattttggacttccatcagctgtgtatggcagcctcatattctcactagcacaagcacaagcatgctttgtcttgtagccattcaggcaggtgtgggataatttgcatttccctgctgcctagtgaagttgagcacctgtcttagtttgggttccctaggtggcgaccctgagacaaggatttgagagcaagaagtttcttggcaggtgtgttcgtctcctaaggctgctataacaaaataccatagactggtgtcaaaacaacagacctttattttctcacagttctgaggctagaagaccaaggtcaaggtgccatccacgttcgtttctggagaggcctctcttcctgccttgcagatggttaccttctcaccgagtcctcacatggttgcttctctgtgcatgtatagagaggcggagcaatatttctggtgtgtctttctcttgccttcaatgtaaggacaccattagggcctcaggcttatgacttggtttaaaccttaattatctccctaaagacctgatcaccaaatacagtcacttgggaaggtagggagacgtgattcagtccatcatagcaggcgatcctaggaaaactcacaagggagtgaagaagtgacagcatgcgggaggaggctctggaagtgcgtgtccacaagccagttgccaccctgggcatctggagttgaatcccacggggagattctgagaaaccacgtaaaccacgccctcgagagttatcccactcagggcgccggggaggtggacttctatacatcgactcctgccggtcactggttgaggcctatttcaaagtatgggggtgtggggtgggggcggtgatgttagctccctggtgcctcccaggctcacagaagccctgaggctcggagctgcgggtacacaggccacagcacgtcctcacatgctagtaacggtcgaatcctcacttgagtgaagtggttactcttttgaagctgagttttgaaggatgtatacagatgggccaggcaggagacagcattccagcagagggaacggtgnnnnnnnnnnnnnnnnnnnnnnnnnnnnnnnnnnnnnnnnnnnnnnnnnnggtcttccagggccccccagtcctctgactctcccaaatcctgactatgtactgcaagcaccactgaatgccagaatgtctcccatagccagagacatagacgaagttcccagcagagaggctgcaagccaggtcggggccggagcaaggacaaagggaccagcgttcccagggcaacagaggctcaggccacaggatgggcatcagagaagtcaaggcagatctcaaggttgacattaacaaaggaccttgagctaaggtatggggtcctgaagccctgagaaaggcccacttatactcacccccatgccacctgagttcagactgtgctgatcctcctcagtgtcctcccaggtccgaaaagctgtgcatgtttacactgtctgcagagcctaaaccaggaaggcagagggtcagggagaggcgggcccagggctgtgggcttggatgagaaccccctaaccaccattttgacctgaggggaactgggaagtgggaacctaagacaggtctgagcaggctctgactgctctgcagagctatcagcttggagtccagccacatccagttctgtatccaaataacaggcatctcatctgcagaagtataacctggcagggcccaggcatcgtgagtatctgtcagtccagccacactttggcaagtcatgtcccccctactaatcctgctctgtgtggcttgggtggggcagtctccccacacccaggcggcgggcttgtgaaccatgcctggccaaccatgtccccacccccaggtgccgtgattgactcaaggataaacccaggaccctacccaggccaacaggagtctcccttgagacttttactagcgatgtctggaaactctctcatctgctgagatcctgagctgtaaagaagagatgggaacagctggtggacagcttgcaagatagagaaaatctgcccagaataaaagaaagaaagaaaaaaaaaaaaaaaaaaaggcaggcctagctggaagatggagagagagagaaagagtctttgtggtgtcaattaaacacctgggtgcagcatgtctgaagttcctggactcctcatttgcatgagccaacacatttcctgctgcgtttatgtttcatcatggtttctgatgcttgcagtctgaaaggatctgatgaaaatactgggtgagaacacaaccagtgttcctttctgcaccttcatatctcagagatgtgcacggagtttctttaaaaagggcctttgcgattggaatgttgcagtgaggccaagatccctgtcatgctgcccttctttgccaaatgacaactaactgactcaaagtggagtaaacactgccaacagcttacattcaagagttcaggatgctactcccactggaagacctgtcctggaaagctgccctctgcctgactccccagagtattctggaaggtgcatttttctgaccaacagtcaggattaattactttttcatttgttgaaatatgggggtcagagttatatagacttaagagagagggaagaaaatagtgcatttttgcaactccagcctgaatgggcaatattgcacgttgcacgacttgatttgtttaattcaatgaagctcgacaatccacccaaatgtgtttaaccataggggtttggttaaataaattataatatatggattaaaaaagaagtaaggtagctctgaaatataccatcataaaaatatgtctcatgtatgaagtgttaagtgcactttgcacaatcacacctcaataaagtgaagttttttcaaaaatcaatttgcccaattatatgtataacatatgcccattaaaaaataatacaacagtcctataacttgcaaaagtttgtcatttatatgattaggtgggggaggtgggcaggaaaggaaggcgaaaacaatttgcaattaaagtaactcactctccttggatgattcagtccatgccagctttagttccctatcagagctatttccccttcacaagctatttcccaagacggaaagaagtataagcttgggaggctatgaactagaaacttgggcgtctaagaactagaagctgggatgtctttaggacttcagggaagagttcctccctggcctcacatctctcttgtaagaatgcctcatcctatgggttcagagtctcagttttcatcccagctgccattacctgtgcagcaggcagagcccagggctgattttaaccttgcaaagactgtagacgctccagaagaggagtgctgatcaggatccctgcagtctggctaggacttggggacattgtgaccctgtccagggtcctgactggcaagtgacacaccagaactcagtggctttctgtgtcccctgaggggctgggaaatcaaggcaaccccttcgcatcacacaggagacaagcgtgagactagagggtaccattcctggtcttctctctgcctgaacactctgtagtggcttgaatgctgacccctcagatgatatgtccacatccgaactcctagaacttgtggatgtgaattggccaaagggtctttgcagatacggggctgccctgatagctcagttggtaaagaatccatctacaatgcgggagatcccggttcaattcctgggtcggaaagatcccctggagatgggataggctacccactccagtatcctgttattcccttgtggctcagctagtaaagaatccgcctgcaatgcaggagacctgggttcgatccctggttgggaagatccttggagaaaggaaaggctgcccactccagtattctggtctggagaattccatggactgtacagtttatggggttgaaaagagtcggacacgactagtgactttcactttctttgcagatataattaaattaggtctcaagatgagatcatcctgaattatctggtggggggaggctctaaacccaatgacaagtggcctttcaagagaaagtccaaggaagatgtgacatagaagagatgagagatgactcagaggagaagaatatgtgaagacagaggcaaagactggagtgatggagccatacaaaatgccaccaactaccagacaccagaagaggcaagtaacaggctgccccctagggccggagcatagccctgccagtactgagatttcagacttctggcctccaaaactgtgaaagaataaatttttaaaccacttgttacggcaacccaagaaactcatgcacatttcctgctctcctttctactctactgtgggtatggaccaaatagccctccagacagcatcctacagagttctagaagtgggcagaagtcccctctggggtttctagcttttctacaaccgctcccaggctggggctcagagagaagggtgaggcacaggcagcctcttggcatcactctttcctcctacgaatctgtttttccagctctctaatggctcctctgagaaatggaagctctgcctacattattccgagctgggcaggcatttcaccctgcactgcaccataaattctttctacccgtgccttacagtaaaactccatgttcagtcctccaagtttgcgcctggcatctgcaggaagtcctgggagcagacaactctgctttctctcttatagtaggtgctgctgattctctacccaccttctctttccctgctccatctctttaaaatgacccagttttcattccggagtccatcttgcccttacatcacccacgtgcttcaggtgaggctaaccccaacctcagctctgggggctgctctaactggtggcatggaatctatcccacgtggtccagaaacccaagcctgagtgccagtgcagggcacctctccggccacagaaacaggcatgcaacaccagccatgatgccaagggaaatatactgggacctgctggaaacaggtatttccttgctgttagaaggatccaccagaagggacatgttctccttttcccttggtgtcctggtggtgaatgtctggcaattctgaggggagccaaccccaggatgaagccatcagacagagcatagccaaggggctgctgagttctaggccagagttgctggattaagccagtcctgaagcccaccctgtctctggaatctggttacctgagccaatacatctcattgttgaagccactgtgtcttagacttactgttacctgcatcccaaagcatcttgccaatataccacttgccacagccagttttttaagactactgtcctgttatgggttttgagatcctattttgggagtcaaaagctaactaagcattgttccttattcctcttacattattattgtagcaatttttaatcctccctaaggcagatggatgcctctggctcaataggaggaaaattcacataaggaagcttgagaaaaaatacacgttactgtatttcaaagaaatgatccacattaccctaacattcacacaaaaaacctgggggaagaacttctaaactgtgagcaggagcagctgaagaggacttgggggatatgtgtctccctttctaggctagtatcactgtaatgtttgaatttctagagtaagcatgtattacacttgtaatttaaaatcctgaggattagagtcatctgaggcatccagaattccccaggtaccgtccatggctcagctgtcaatcctgcagaaagtttatttgtggatcagagcaatgacttaagaagaatagtcacaatgtttctttacaatttagactttttgtttcaacagcgtacactgatctagctgagtgcatgttccccgccacaggaaacccttgccaaatctgtgccaagtggtagttaacaggactttggtgtctcctggggtcaggagaggggctgcagctctgagtcagccacagtctgcctcctcccttccaccccaggatctctggcacaaagcgcccatgcctctgtgaggtctgaagggcctccttgcaaactccaatcctgtgtttatgctcctcctgcaagaaggatgccacctcctccttggacagagatgaggaccttcagtatctccagaggggtctccagactctgggggccagagaccacagcccagaccccagtgccccgagagccccctgctctgccccagggtccccgtcactccctaggggttctcttctcggcttagtcctgatgcaatctccaagctcaactggcctgtctctgtcatttcccccaagctgataaagccagaaacctcagagtgagtggaaagagcctctgccctgaccagaagaaaccgcagggctgaccccataccccacagtaagagctggagaggctgggctctgggctcaacgcctggggagaggaggaagaaagatgaaagagctgaagaaaagaccatttgctatcacccgctcacacctgtccaccactctctcttccctggatctttccctgtgcttggtccctggactctgtccctctctaaagcttctggctccaggatcagaaaaagcctcagtgcgagcctcagttctagaatctcaactctcagaaaggctagtatagggggcctcagcactcccctgcccagacatgcctggggtaggtctgggattccttcatgctcacctcctccattaagggctgggcacccactagaaggcatcctgttccccatgggtatccagaaccctcaaatgtcccaaacctcctcatccaccctcacctctgcctggatgggcagtagataccccaggtctcttgccccagtcagacccctatgcaccaggccctgtgctgggcatcaggttcagagatgaggcaggtccctgctgcaggacagtggggggcaggggacagcaggtgggccaatggccagatgaaagcagtcacagtaactgccagctgctcggcccgatgccagctggggacgtgatattgaatggtcacgagccccttccccaacaagcagttcaagttcccagcagtggtctgtacagaagccctcgccagatgcagcatcgctcagagaggtcctcctggttcgcaggatttaacaagtaacccctgctccacggtcctatcgccctctagcattacgtgctcgatttgctcttccagtcacccactcccatcactggagtgtaagctcttggaggcagtatctgggtcattcttacaccccagaccctgggatgctgtctgggcactcacagtgtatttgtgggtactggatgtgcatgaaaggtggttgctggattcttgtccctccttctaccctatcagtcacctagccaaaccacccccaagacctgcagaagctgtctcttctgttctgtcatctctcctcctcgccctccccagactctaaacccagcctccccagcccttccttggtatttcttaatctctaactgctgctgctgctaagtcgcttcagtcatgcccaactctgtgcaaccccatagatagcagcccaccaggctaccccgtccctgggattctccaggcaagaacactggagtgggttgccatttccttctccaatgcgtgaaagtgaaaagtgaaaataaagtcgctcagttgtgtctgactcatagcgaccccatggactgcagcctaccaggctcctccgtccatgggattttccaggcaagagtaatggagtgggttgccatgctttctccgcctaatctgtaagcccagttcaaacgtcacctcctctgtgaagccagctcagatccctttgtgggcacattgcctgtcacatgatcctactgggcgctgcagccacgtgtttatgtgtctgcggcccccgcccccaccaccacctccactgctgaacagaagatcttcagaactgggctggggcccaggtctctgcgtccagggcttctacagagaccagggctgggcataatatcagagctcaggaacgatctgtcagatgaataaaggagtgagtggagaaatgaatggatgagcccccgttagtgagggatacgtgaaggagcaggcggatgcatgaatgagcaagggaagaagctaccgagtgaatgagtcagtgacttggggtgggggggagggggagtgagcctgtgaaggagagagagccgtgagggtttcagtccgctccagcagccctggcagcagccagcccccgccacccctgggcctgagctccgtgccaaccagacctcccgatgcctcctcccagagccagctgccgtcagcaccgctcagcacgcgctcccgatgctggccagcccctgcgctgggccatgaatcagacagggcactgccccagggctcccaggacccggggcagacagacagcctcataaataaacccgatgccctgctgggcagacatgtgttccagcagtgcagtgagctcagggttggctctggagccggggctggcagggcagagcctgatggagaagcctgggagagcctcaggaagagggacctcagggctgggcctggaggagaaagggcacccggggcaggagggctggcagcagccaaggcacagtggcttcgacagacacaggagtgcagggggagggcgtggtggaggtgggaacatggggaacgcagggcctgagtggtggggtcaagaagttgggattggcagagccagggctggggacacagcaggatgtaagcagagtggggcacaaggactgcgggctggcggtgctgtatctcagaaggaaagatgggaggctatggggaacaggtctgtgagtttctagggcgctcagggctgtgtcctgctatagctgttgcataattgagcttctggcttctctccacaaagtcaccatcatcctcccagccctaatactcaccaccagcagcttgaggctttggagcacccaaattagggaggttactttggtgagaacacttccaagtgggtgtttttaagccaagattgttttataatggttcagatcatggggaagatcctggggtttctgaagcaaatcagggaatttcagaatttgacaggaaacctcccagttgaatgggtggaggccaccaattcaaagatgctgagcatcctacagtgcacaggacagcccttcacgacaaagaatgacctagtctaagagatcaatcgtgccatggtgttcaactctttgcaaccccatggactgtaaccctccaggctcctctgtccatgggattctccaaggaagacgactggagcgggttgccattcccttctccagaggatcttcccaactcagggatcaaaccgggtctcctgcatcacaggcagattttttacctctgagccattgggaaagcccagtgtcgaggttaagcaacctgctttcacaggtgggaggactaagacggtgaggatgctagaccaaaaggtggtctccagtaattcacgtgggtcttcatacgtgccaggagctgttctgagaacctacccccattcactcatgtcatctcttcctgctttgaggatgaagattaaagacatatgtgattttcccagggtcacacagctggtgggtggtgaaggcaggattcccacccggattgtctggcttcaaatgctgtgctcttgatcatgacatcccatggtctcccacatcacccagcagctgggacagagctgggcttgggcccagagcccccctctccaggcagatgttccttccactctgctctgggccccaggtccatgtaggagtcttgggctcctccaccaccacagacgtggagcttagcaaccgggactttgatttgtgagggatgcagtgggtgggcaggaggcagatcccagggacagagggcctttgtctgcctgcagatgggcaggggccagttgggtgcaaactcattagacagctgccgaggctgccaaggagacgggagcaattagcgggcttggctgaagccaggaagtggaagccgctctgtgagagctgctgagcctccctgccctccaccaggacccagctccctaggaggcagctgccaagtttatgttcagtttgataatggcagctccaaccatccttacaggttgaacctactatgtgctgggctaggcacattccatatcttgtcttttttcatctataatcacccccacccaccttgggaggctggaatgactaactccattgcatccacttagtcatccttccattcattcgacaggtattcatttattgggtgcctactatgtgccagctctgtgctaggtcccagagatgcagcagccaacacagcagacaaaagtctccactccagtggaccttctgttctggaaggggaagacaggcaacaacaaaaaagaaacaaacaaggtaactgcaacttgtgatcagggctatggaggaagtgaaggggctgatgggaggatgctggggataaaggaatcagggaagctctctctaaggaggtgacagttcacaggggagggacttgggctccgagaggaaaggtgacttttccaaggtcacacagctggaaggtggaggagctagggcttgcctccagccttgacctgggcacctgcctcacaggagcccctgcccctccaccaggccaccatccacagctgtgccacacactggcaccgtatctccaccccttcctcatggcagcctcatgaaattcgtggggttatcacctccatcttacaggtggagaagaggcccagagggggccttcacaaacccagggccctgcaaaggaatgacagacaaggggcttgagcgtcttttgatccccaaacctgtattccttctgccacacctccatccttcctggccaagcacttgacgcgcactgagcgtttagtaggccgataagaaacagatggatgcatggactatggggccttgggcatcatctcctttcagtgcttccatttctccattagagaaggcgagagggtccagaccagcttcaaaatgcccaagttcattctactctgttgacattccttgaggagcgtggtcccctatggagaaaaagatgaaagggactctgcctcccgcagactattctgggcggagcaaactgcaggcagaagcatggaggtgggaaaggaaatggcgaggagtcagcagacatgtttaggacgcggagagccacctggaactcatatctaagtgtccctttccttttcctgcattcttaccacctgtcacctgcatagggtcttaggccaccagagcttcatctcctctcaattccagctcttgcttgagtcccagagagtctcccagaggaggggctgaagcagatcccaaatatatctgtgccaccaactgtgcacagtgtgatcttggtcaggcagctggtcccctccctcagccttggtcttcctatcgattaactggggagacagtgatcagagcaagtcggtagcacaataaaaggtgaggtttatgagcacattctccatgtcaggcagtcatcccttgagacaggcaattttgttatccctgatgtacagataagagatctgaggcttagggaggtgaagtcactggcccagggccacacactaggaaatggctcccccgggggattcacgcccaggtccatctgatgccagagctctgctcataacaaaaagctcatatgaagcaatgccctgccctttgacccacgcaacactcaacccccaggactttactcgtaggaaataatccaagagagccaaaaacctgttcacagcgggcctatttacagtatggcagatcactggaagaaatctgcatgcccaacgacagggctctgttcactttagaaattaggcagcttcagatggactgtggcttactgagcaccagctcttgccagttgctccactgtaacccccaccctaaccctgcaaagtggatgttgctttctgcatcctgggtgaggcctccaagttcagagtgtgaaggattggctgagggctcacagccagtgttgggccagggcatgagtggtgtggccaggcctgttcacagccacaccccaggtagctctgttctacaagaaaggaagctaaggcaagtaagtgacccagtaccacacggctgataagcagagaactggagtttgaccacaggaactgggactgcatactctgggaccacttccccacactgccacctactgactgggaaactgcaggcgagtcatttaccattcccaagcctcctgggctcctcatctgtaaaatgagaataagattgtctgttgcgcatggtgtcaccatgtaagcagtggtaaagatagcaatggcaacactggtaatactgctattcacagtcgataccaccgggacagcgttctgccgtgaaaggaaaccttgcctgaacgttagaaggactggctgcaaacctcagctaggacacgtctcaactctctctgggcctcagtttctccatctgtaaaatgggggagggcacacttgagcatgtctccggctctggtggtctctgagcccaggaacactgctatctcgggttttccctgggactctgcctgctgacccctcatcacacactggtctgggggagcgggggcgggacgcagtgggtctgggcttgaggacacatgtactggaggaggacaaggggcccttggacagggaaatggaggttaagtcaggaagccccaacactcagcccctcaacacacagcccctgctcctggcctaagggccactcaggcagcatctgctctaggtcctttgtacctctgcatgggacctgcctctgccccacggcctcagtctctcccctccctgccagcccctcaaggagatgctgaaccttggtgaagagaaagcagaggaaggcaaggaaggaaaggctgaggggaccaggagaagaggagaaagcaccctgagaaggaggggtgaagagcatggttttacataatggatggtaggggtgggatgagaacgaggcttgggacggggtagggaggaagaagaagaggtcaacagaggggctgagagggtctctgacatttttcagagttccctttaccaaccctggtgaccttcgggtgccctctctttatgtcctgctgactggatacactgggagccaggcctttcacagaggtcatgccagccctgagggcaggcctcccacatggctccagccccataggcggccacacagaagggccaagggatgtttgcgggacaaaggacttggttcactctcccaaaggctctgaactgagaagaatgtagacatcatccaatccacctttcctcacctgccgccccaccccacccccaccaagggaggaaggactttctcagggctccaaggtggggatgtcgatgtcagggccagaaccggaacccagtgtcctgtgtcttgggcctttctccagcccagccctggagggtcccagcagcaggaagaatccctgcctctggttctggcttaataaccagccacgaggcggggctcagggcctgcggctcagctgccagtctccccaggttgcaagagcattaaatggcctcagtgatgcacagctttgactcctgagcaggcgaggctggtggcagagaatacactgatgtgacatctgggggctcctgggagcctgagccccggacaaacctccaccagcgtctgaggaacctcaggctctgcagagtcagtggcacagaggcccgcagcatccttggaattgaggcctggtgtggcagaaagaggagaggccagatgacccaccgagataccccagaggcagcaaagctgagagacacagccagctgcaggttaagagctttcaaaaactttcagctacagccaaagacaggagatcagtttgtaaacagacaacaaaatcccacaacaccctcagatatgtcctaactcatctctctgatgggctcagagctggagctggcctgctcagattcctcatccctttccaagaaaggggcagcctagccttggacttggagaggccaatgccttcctcaggccagttcttctattccctccccatccaaatgcatcaacaaatcccctctgggtttattttcttccctccttccctgcaggactccagcctcatcccatcagtggtgctcacccttcctcccaaaccctccctggctccccatgtcaacaaggtggcattcagactacttgacttgacattcaagtgtgatctgctctctgacctcaaaccctactgctcccctctgccccaaccatgactctcagtcttgggatgttcttgccacaggaactgcacattccaatctggtagtgggcatgcttttcctctgaatgcaggtgacccatgcgtctgccccaatcagtggggccatggtagaggggactctcaaccctaccacttcctggaagtgtgaccttggggaagggagtctcacttttctcatctgcaaaatgggaatgctgatcccttcacgggattcaaaggtctgggcacagtgcagatcacagaactattattagctattatttagctattattggattccctgatagctcagttgataaagaatccacctgcaatgcaggagaccccagtacaattcctggatcaggaagatctgctggagaagggataagctacccactccagtattcttgggcttcccttatgactcagctggtaaagaatcctcctgcaacgcgggagacctgggtttgatccctagttgggaagatcccctggaaaaggctacccactccagtattctggcctggagaattccacggactgtatagtccatgggtcgcaaagagtcagacatgactgagcgactttcactttcactttagctattatttatcaggatcagtgctgttattacttcgtgcggtcccacacagcaaacatcctaagcaccgggccactggcaggccccaagtctgtcaaactaacctcacatgataatattagaaacactcgcctccatctcaacttgcatatgtgaaactgaggcccaggggcccaaagcccagctaacagcagaacagaccagaagccacatctcctgatttccaagccagaactctttccctacaagctgccactactaaaagccgagttcagacgccaaactttaattgtgatagtctcagtttatacaagaagaaaaacctttgctccatataagaatctttattatttattctcacttttaatgccccaccttgaacattcctatgtaccttcagagaacacccccctcctcctcctcctaggcaaagctcactcctccagctgctctttctccccacctcttttctctctccatccctggggaagcctttatctgaccttccctggcggagccaaagggcaaatgctggcttgcctttttgctgctcagctaaaaagctgactgccttttctcactttctggattgtgttgttgttcttagcctcaagggtctaccctgtaagagaaaaccagaacctccctctccaaagcctttatctattcccagttcctcccatcttaaaaaacaaccagggaccagacaaagcaaaccttcttctaccctcttctccttcagtctggcccggtttcttggtggtgacctgttatctccaggctccatctccttggcttcatctcctactcgccaacccatggggttgcctctgctgtgtcttctgttcaggtctgcagcgactccatttcccccaggtgtgctgggctctgggtagccttcaatctgcctgatctgtctgcctcagtttcctctctgagcgctgtctcctgggggttgtctgacactgtctccccacagccctgccagtaacttctcaatgccctttgttgggctcctcctccatccaagccttgacattctgtcttgggtcctcttgtcttcccatgctccttcccttggcctccttataggctgaatttccatctctagccaatgattgctagagtccacctccagcccaaacttttctcctgaggcccaggcctgggcaccctgttgcctctactggatgtctcttgtctttttaatgattatttatttgtttatttggctgcactgggtcctagttgaggcatgtgagcgcttagttgcagcatgtgggatctagttccctgaccagggatcgaacccggattgattgattgatccaggggtcaagacagggatcaaactctccattgggagtgcagagtcttagtccctactgggtgtctctaaggtagcatcaaccgagcacatctcaaatcatctcatcattttcttttgtgaaacccatctcccctcccgagcccccagctctacattcagccccaccacccaccctatctttgaagttgaacacctagaagtccctgatgtgtcctctttctcacccccacacccagtctgtcaccacaccctgctcagtccatcttccagaagcctgtacaacctgtccaggcgtcctgagtccaccacctcgacctcaatccaaacactccacttctcccctagtggagagtcctaacgggtctctcaaagccacacataccctgtactgcattctcacagcagccagaggggtctttctagaacacagatctttccatgtcatttccctacttaaaactcattactgtctgccaaatgttctccagtgaaacctccagatgtttggcgtctggtcgcaccctccccacccaccccccaaacccggccagctctctgagcacaaaccactctgtcttttcagctttttctttcaatttgctgtatttcttcctgcctctgaggctttgctgttgctgttttctctgtccagaatgcttctccttcagcatccccaccaacccatccttaagagatgaggccaagggttgcttcccaccttccccccagggcctctaggatttcgacagctgccaggctgtttgcgctcacccctgggagcttgtggttgcttgattcatgtctgtctgggctcctggactgcaaatcatgaaggccaggggccatgtctgtcttgctcatcctaaaaccacactgtgccaggcccacagcatcccacagccccacctgcccaagctacccccagtccacaaagccagcattaactgccccagagaccaactccaggctggaattcaaggcctcacccttccaaaactccccatccttaacccctcacacacaccttccccatccacactggggagcctcctctctcctccctttgctcccccccatttttccttcatccttctttctctaatgatattcaagctcaccattctccaatgatgcttctgttccctgaccacacagcccatcttattttggattgacaggcatcctccctagcttcaggatgaaattacaaggcacttgaggttctccataatctggctccggcctacactctcagatctccaccacccacacaagagtaatctggcacaagaggacttagccgttaaaggattcttggcctttctggattcaagccctgcttgcacttcttacaaacttcaggatcttgagcgagtactttgctaaacccctatttcctcacatgtaagacaggaacagttaagagtctccacctcattgaattctgtagagattaaataaggaaatccacaagaagtatttagcccagcacttggcaccaagaagctccaagctcctttcctctatcatggccctaattggttaagaacctgtccttcccatgggtcctatgttcagaggggatcctgggtgcctttcatctctgtttcccctttgcctagctcagtgcctggtcccaagaaaactcaataaatgcttattaatgcatagatagaccacacacttggcacaagtcatctcattgttcttcactttcatgtgtgtaaatcttatctctcctaacagagtttgagcttcagggtatgggggaggtggtgctgggagaaggtggtgaggtgtcttcatgtcagagcatccagaatgggagggatctctaagctcttgacatccctgtaccccccatggtgcccagcctggagcagggagtcatgaaggccttgttgacagatgggcctgtcatattccccaagaagaaggcacgtctcccgctccgagatatcgccctaattactccctggtccctcccctccacacacacatcggctttcttaggcaagagcctgcttgacttacacacatggagttcttttagctggtggttctgagccagctcagccagtttcttcagaaactacagcagaaagagaggaaaggttttttaaagccatagggcacaaaaccagagtgagggatgggtgaagtttccccagcaaaaggccagcaatggaccagcattggtcagatcatctcagcactgttccaaaggcaaacctgatggcatagtagaagggttaagtgtgtcgggctctgcactcagagactctcaggtttattccaggctttggccctaaccttctgggtgacgctgcacaattgacttaccctttctaagctcagttcccttggctatagagtggggacaatgttagtactaggaggatttaattagacaagatatcaaagggttggctatcactatgattatgatgatttttgtcattattattataataccattgaatataagatccagaaggaacctcaaaggtcatgtgagaggagagaacactgcagccagcagaggtggcctgactttgctaaaacatacagcagatcagtgcttttttctttacctctttcgctgacatctttcagagaaccaagggagtttgctcacttacccctgaccttggagttggtcccctaccttgacttgaagaacacagatttgggggtcttgaagccaacaacgaccaaaaaaatgggcattgttttcaccaatgggccctcgccagttggaggtggcccagccactgctgacaccatgctataggatggagcatggcctctacttgctatccatccttgaggaagggactgtgggctgggttcactataggcacagcctggacttgggaggcaaggcactgtctgctcccccttctccagctgagttctgcactctggcctctccttagcccggcccaggggctctgcctgcccacctgcctgccaaatggaatccctgcttccacccatcccaaatgcctcttccccactgccctccctctccctgaggctgggaaagacctggctggtccatctagaggatggcactgggcagggggcaaggcttagggagctgtggaaggccgctgccccgggtcaagaaggcaggtctccagcaatcttcaagggaggtgtgctctcagggctgaaggggagcccaacagcactgggagaaaaacaaaaacaggaaggcttgccatccagtaggcagctactctctccttggctcaaattacatgtcattccagtcaatcttggcaatagctccttctccactgggtggtttgtgagggcggagtgggaagctacatccacagcagagtacctggaaagaagaagcttgtgttaggggtgcacggtgagagaggctgccagctacttctctgtcgaagtactaacagaggtgccccttagaatagaccttccttgttcaggtacatctccctcggccagggtggaggaagcacgctcctctcaactccccaaacacaaagccaggaggtccccgtggcctgacaaaggcttctactactccattggctacagagctggcctcagaagcatcagtgggcaaatatgcatggggcccaaaaagcttccatgatcagggcctgcgtggggcacgcatgctcaggcactttagtcatgtctgactctttgcaaccctatggactgcagcccgccaggctcctctgtccatgggatcctccaggcaagattactggagtgtgttgccatgcccttctccaggggatcttccttaaccaggggtcaaacccacgtctcctgctttgcaggcagattctttaccaacgagccatcagggaaacccttctatgatcagcactgtgtcttaaaagttgggataacccattgtctagaaaagactccaaatagctggtcccctctccatgagggaagggagggtctgaaaggaggaccagattcagcacaatgtctgggattttggtaggagagctggttctggcttcccaagtggctgaagtagaagcctctcttggcctggcatggtggtttgctttgaggccaatggctaagaaagtgctaaccttggacccaaagtgcagagatcgcaggagcacaggctccactgaaaaggagaacaagggtccgtgaagctgagcagagcacgtcttccacagcgcccccattgtcagcagcagcagttagcactgatggcctggtgaggactagtttctctcttcctgacactggaagtaggagtcttctcttgggacagagaaaccttctgggtctttctggacaagggacggcaatggcttcagtcaggagacactgaacttccattaaattccacaggcagatatttgagcaattaactggaaaatgaagacttgagaccagtcctcccaaactagtgaggtgcatggttctggttattgcatagaacttgactatctcgttggttcctcataacagctcaacaagcaggcataattatacccactaaatatatgagaaaattgaggttccaaggagtcaaagacacgtgccagttcactcagctgggaagtgttggacctgggactggaatgatctctgctcagtgccccacgagattgaacagaaacctgaggacccagggccagcgcttctcatactgactctttcctatccttcagattacagtttaaccatctcctcctcaaagaggccgctgagccccagaacctgcagtgtgttccccccaccccatgacatctatacatctggacaatatttcttcctttcttagaatattatcataatgatcataacctcatttttacttgtggttttaaaatctctttgatctgcttctctctggagaatgttttccccacgagacagcacataatgtgcagtgtgcaccactgagccccaggcccagcacagggccgagcacatggtggaaccctgtatattgtttgaaggaatcattgagtagatggttaacgggtacttgaaagcatgtcctctttggatggcatgaaaaatcaagatgatcataagagagaggagaaaatccaggagagacacaagaccccatctccaaattctaaagggctgtcctgtaactataggaacaggtggggtgggaggcacaaaactggggttgctggaaagcaggactctcaatggttagggaaactgagcccctttcgaggctcctgccctgtataagcacaccctgaccatctatcccttcctgccccacctgggaaggactccagccatagctaaaggaggcttgtcaggcctgagtggtggctgctcagggactcaaagcaaagcaggttgttggggcgggctccaaggaggaggtgagctgcagggcttcctgggggattatcaggagcaaggatctctgggcagagacatgggtctgtctgctgaaacttgctcagagcagcttctgggcttcctggtcagataattgcaaacaaaatagaccagggactgggcagcagctacaaacccctcttatataagagaagggcctgggctgaggcatgcaggagcaggcagcagggccctgagtcatacaaggaacgagacccattcagaacagctaagattctggcctcagaagctttcagtgatgatgctggtggctttgcctttctctggccgcaggcttcccatttgcaaactgagaaccactggacatccactctgtacctggccagcactggggagaaggaggcattgacactacctcccagacacccaggaaggagcaccaactgacacactctggttcagacccggggtcagggaaaggcagtggggtagggggatcagcagagtacttccagaaagaaggtggaggacccatgctttaagctctttctctgtccctcttaaggaaactctgaccacccagaagagactggaaggtggccaagaaggatctagccgcaactggccagcagtacctgggactcaggtgcctgggtttcctcggggaagtgcacatttatgctcatttgtattatgctgcaatgtacatatatatatatgcaaatcacatatttgtgtgtttgtgtatgtgaatctctatactcctctgtgtgtgtttgcttctaactaggtttaattccaactctatgtgcccatgcatatgtgtgtgcccttgtatgtttctaggtatacacaggagtccaagtgattacgtaagttatacacatttattcattccagatatttatagggtgcccattacatgctacgtgttgtcctagggctgagaatgcagaggaaaaaattcaaggtctctttcctcatgtagtttgcctgcagcataaaagataagcaataaatgagggaataaacaaatgaataaataattgcagattgtgatcacttacatgaaagggaaaaaagcaggataattagagagtgacttgactttacataaagaggttaggaaagacagcttggaaatacagaaactcaggcctcaaacaagacctcctaattcagaatctgcattttaacaaggtccttagagggtctgcatgcacatcagacattaagaaactctcattaacatacacatgacatggaggacaaagggaatagaggcaaatgccacagatctccttctgctgctcgccatgagataatagttgggattcattgatcagtttccttcttccctgggcagaattctttgcccacaaaaatcactcaaggatctgaaaccttggaggccccgcccaactaaggctaccgcagtcttcagctgttgctgttcagtcatgtccaaccctttgtgaccccatggacttcagtaagccaggcttactgtctttcactggcgttccctgtctttctctacctcctggagtttgctcaaactcatgtccattgaatcagtgatgcagtcttcagttaacttttagcctaagacattttccacctctgttactcactgcccccactgagaatcagaaagctgatttccccatgacagaatcagtaaccccagtcacactgaaacccccttttctactagcttgcccaaagacataaggagttttcaatggtcagctggcgttcttaacttccacttgaatgcaaatattcttgcatcctctagtggaaacattccttccttgggcaccaaaacttctgaccccaagtttgaggggcaggtccttaggtgggattgtaggcactgccactgctccttctgctgctcagcccctggccctgtattccagctctgggagaaatagtaccatgtatagccagctgattaagagtgaatacagcatcttataggatgccccttccccaccaccaacatcacagtgtcttttaattccctttggctctgggacctagatttttattaggtcatttcataattttataggtccattgatttcttggtaatggggtacccgggatgaccaatggatccaattatcttcagtccattggcttactcctctccctgtaaaatggatttcttgatctacagcaatgttgtatgggatatcaagacagtggatgaggtattcatagagtctgcagatggttctgctggaagaattatggcaggcaggggaagcagatccaaatccagagtaagtagctgttccaatgaagaaaaattgctgttcctcccatgaaggaaagaatctgatgtcgtctccccctgaccacgtgacagccacagctgctttgtcactgagtccactgagcaagccctggggtgaccaggaaaagacaccaacaggcatccacaggaggtcatcttgaccacctgtttcttaaagccctttcttccagggtcttcaggtttcattcgagtgagtgttcttataggacacaagtaaactcgtgatgttggatccattctgagggtccaatcacatgccttttctccaagcttctctttcaccaacccttcagtcctgtctcttcccagtccctgtccctctgaccaaatcattagccacttcccatacatcactgtagaacataaacctctgttcttccagaccgagacagtgagacacaccaaagtgctgctcactgcggggatttctctattctgtcctccagggatacctctaaatggggctgtaattacacagcctcacactctactagcataacacgcagagccatttgttaagcaggctcagaatgcttttctcctccatacatgggctatagggaattcctgtgagagcgtaagtgtctgctgagaaagatgcagtatccagcaggtgtgagccacctcttatgcaacatgcttgtgctttcaggacctgcttgggtccagaccactttaccacctccactgaaggagggagtactgttgggtgtgctcagtttaatgggtaggtggacctgataacacagttgttctcttggactaaacgattgcatcatagtctatgctcaggtggttagcctctgttagtgccaaggggcaagccaagagtcatttctcaagaggtgaacatttgccagagaaggcatggtcttgctccaaaaatgaagcatctccagccatgatgctgctctctggtcttgccaaaagactccatgcagcatctcaatctgccacaaactttcagtacctttgaatctagtatattataaaaacttggcttgaagtcttaactagctcagatcccatttaaagccaacagcttttttgctcactcaggagctggcttgaagtagaagacacaagtgtggtagatgttgcctctaaaacccaaagcagcccaccgagtgataagtccctttcttagtgatctgcgatgtagagtgtcacagcctattcttcactttgaaggggatattctgaatttcccaggctgatattttcccagaagcttaattgagttccctgtattttctcagactatttttccttcaccatgcctctccaaatacaattgtatttcaagatacttattatcttatgatctctgtgtcctacgagtaagatatcaccaggacgtctctggcagtccagtggttaagactctgcttccactgcagggggtatgggttccatccctggttagggaactaaaatcccacatgatgcactgggcagccaaaaaatcaccagtgttctagatgaatgatgaaaagatcgatgtccctatgaactaactcgttagagggccagacgtgaaattagagttgacacagcatcatggcgaagtgggaggtgcactgctgttctgcctcgagaagtctacacacttttgatgtcctctgattattaccatagaggagtgaaagtattctctgagtgttaggtttgcattaatttgttatagccacaaaaccatacttgaagcatcatgggactataattggagttaccaatatatattaatgataacaatcccacgttaatttttaagacttatctatcttacgcattggtcaaactagaaaattttgaccttagccttaagctttgtggtcccaccaaagaagtgtcattgcactgacttactactttgatgttgtttgaaaacctacagtggctttcacttaggctccatgggtcagggagccagtgtagtaaatctgccaattctggggttgtctattctaactatacacttggaatctgggtaaataaccacagatagtactgctgtgtggtatggaagaggctcagatcaacattccaaattaaaaagtttatcttatccaaataaatccctaatctaatcaggtcagtctctggggtaactgatttctttagaaatactggagtgggttacccttttgttctccaggggatcttcccaacccagggatcgaacccgggtctcctgcattggaggcagaagctttaacctctgagccaccagggaagccccttcattcagggctagtatctactaattctcaaaatatctagggtctttgcctgtactctgttaccttgaaacatgaccacatatccctttggggaaggacaagagaagttttaaggaattaaattattacccaatgtgttattacatagtgtttcttcaagggggtcccctcctcttttatacaacagactgtttctgcttattgactaggggaggttctgaaaattttccattgtgatagttcagcttattttctactcataagatgcatgtctattttattatatgaatcaatatagggcttttgtgggctctccacctcttctggccttaaacccatgatcattaaccatgtccaaaaaataaagagtgccctgttgtttgaaccattccaattaccacgaggctctgctcactatgacggtcacacacccagcctctaacctcgaagtgccaccacatggtctctgccacactacgatcctcccatttccattgacaccagggacccattcagctatggcaggctctgccaggatgcctagctcacagagcacagccattgaaggggtttttcaagggggttggcttttccttcatcagtgttttcccccaaggtcttgctgaagggactcctaggctttcttaggagtcaaagtttagagtaggaggactcttctttcttctgaatttttacatcaagaaattctttcagctcctaaaaccagaacattgaatccagagctcagcaacatcaggaaattcatccagatctagaattcatccccacatatattcccgagaaattggccaagataaattagcaaagtcttacaattctgtcagcgagtaaactctctccactaaggtttgcctttgtaatttgtccccaggaacatactggaatctgatctagtcataagcctgggggactgtgaggaatgttggtttccctttgtaagataacacccttaggcaaggagtctttaactaaggccagtcttgtctactagggtagcagggccaatttggcaaacatggaggacttcctggggtttgggagtctggattgttgcgtctgtcattctcgggcttagctccatttggattctcaattctcaccttttttggattaattttttcaattttatggaagaaccctgcaaaggttgaggattcaaccattagacttcagcaactaccagaacaaacctttccaggtgtgtgtattctcagtcactttagtcacgtccgactctttgcaaccctatggaccgtagcccgccagactcctttgtccatgggcttctccaagcaagaatactagagtgggttcccacgccctcctccaggggatcttcccgacccagagattgaacccacatctcctgtgtctcctgcactgcaggtggattctttacctgatgagccactagggaagctcctggtgtctcaggaggtaaagaatctggctgtaacgcaggagacccaggttgtaggttgggaagatcccctggagaagggaatggctacccactccagaactattgcctggagaattccatggacagtggagcctggtgggctacaattcttggggtcacaaagagtcgaacatgactgagcaactaacacttttcactttcaccagaacagaccggccctgcctcaataaaagatgagactctttcccagtcatagcaagttcctgaatttcagtccacgccttcaatcaaggctctagggacttttgttcattattttctttccttaagctatccagtgccattaaaagcaaacattccaccccacagtcctcagagtcctcctgccctttattcttctctgtggcacaggtcgtccaagcccctgatggcttgccttccatgggtacttcattttaggtgaccacaagggacactttaattagctgtttcagcactggggaccatgggcttctgggtctcctccctttgtgctagctgttatctcccagccttcagccctaactagggcaggagccaatcccagattcccaggattccctcggggtctgtgcctgcaccccaattacggcaccaagatttgtactaatcagggtacttgtttgcaaacaacagagagaaattctgtttgacatacactgaaaatacacaggcatcaggatgttcatcgaacctgtgcagaagccagaagaccaggcaggatccagagagacacagacgaggtcttgccacaggaatgatacctcaggagctgctccgggggtgtcgccaccaacctcctgtcccaccacaatgatcctcagtgaccctgcaccttaggccactctttctgttgagcagtcgagtgtgagtgtgtgtgtgtgtgtgtgtgtgtgtgtgtaggtgcatgcatgtaggtaggaagagaggaggaccagcgagtagctagctctcttatgggatttgtagggcaattagcactaaattagacgtgacctatgccaggctgaaatcccatctctaccatcaacttgacccagttgtgttatcttgagcaaatctctgaccatctctagacgggcctcagtttcatcatctgggaaatgggaacaatatccattcttccagcctcactgacgtgttgtgctcccacaccctccttttctcatggataggacttagttcaatgtataacgagacatttatttgtgaaggtaccactaatgttcctccagtagacggtaggctctgtgaggtcaaggacttcatctatctgcttagtgctgttaccccaacacctagaaaattgcatgaaatgtagcatgggcccaagaaatatttgaatgaaagactaaacaaggtaaaggatcaggaaggggatttgtaaatcgtcaagggccgcacatgtgtaagtgctggtgctttggagccagagagaccttgaaagtgaaagtgaaagtcactcaatcatgtttgactctttgtgaccccgtggactgtagttcatggaattctccaggccagaatactggagtgggtagcctttcctttctccaggagatcttcccaacccagggatagaacccaggtctcctgcattgcaggcggattctttaccagctgaaccacaagggaagcccaagaatactggagtgggtagcctatcccttctccagtggatcttcccaacccaggaatcaaaccggggtcttgtgcactgcaagtggattctttaccaactgagctatcagggaagccctgctgctgctgctaagtcactttagtcgtgtccgactctgtgtgaccccatagatggcagcccaccaggctccccggtccctgggattctccaggcaagaacactggagtggggtgccatttccttctccaatgcgtgaaagtgaaaagtgaaagggaagtcgctcagtcgtgtccgactcttctcgaccccatggactacagcccaccaggctcctccgtccatggaattttccaggtggagtggggtgtcattgccttctccaatgcatgaaagtgaaaagtgaaagggaagtcgctcagtcatatctgactcttcgcaaccccacggactgcagcctaccagactcctccgtccatgggattttccaggaagccctagagagaccttaattatcactattattgttgttgttataacccttgaattatatatattcagacacacagaattatttttagtgcaataaatgtaccattctctctctgtccctgcctgagatgctctttccctttctctccccctactcttgtgtcttcttttcctctacacttaggggaagtcacccagtgtccccatgagttcccgccatcacctgcacaccagcctcagcaggggccccctgcccaagactgtctgggagtcatctgccccaccccctccctccagctactccaggacttactccagaactgcagttacacctccttgtctggaacctcgggacctgacccaagacccagcctacaatggaggtttaggaaacaaatggataaatgaatgactctctgttttcaaaattataaaaccaatctctgtctttgcttgaggacagagtctgaagaaatgacctaaacccacagaaagatgcactaaaattagaccctaacagaaacttccccagtcgtgttatttactaagccctacaggggagagacagagacgagggaggctttccttcctcctggggaaaagcgaggggctagggagaggaagtgagacccttgggaaagtatacctccattggcagggagctcattacttgttgaaacaggctcctccattaccaacttccttcagcaaccagagtccactcagtcctcatgtttctgatccctacccttcacctctcccaccatcccctctctaaagagagtgtgactttgcagagctggcagccagcaagcctgccaccattcccaaaagaagacagaccttcctaacagtagtggagcaggctaactcagaaggtaatcaactcctcgatggtggaaatggacacagacctgccaagagatctgtctttgtaacacaacctcacttatgggagcactttaagcttaaccttctctcttggccatttgcgctgggttttgaagccatttttccaggtaaaagctgaaggaagggcattcaagacagaaggaatggcacgtatggaagcatagagatggaaaacggccccatgtttgcaaaaagacaaatcatcttgactttcaaggccggaatgtggggccccaatatttactgagcacagactctgcacagatgcaggggtaggacctggagagatactgcaaataagacaaacacacagtctccactctcatggaatttataatctagtgggggaacagaaaagaaacagacaaataagtgtgggcagtcttttcagatggttccacatgctgttaaaaaaaaaaacaggtgacacagtggagaacgactggtggttggggagcacctctctgagcaagtgacatgtgagctgagatctgaaagcagcaaagagatagtcacgcaaagagcaggctgaagaagttcctagctagaggccagcaagtgcaaaggccctgaggcagagacaaacttggaattacagagaaacacaggaggccagtgtggctgaagagtagggggagagtacctggtgctctgctggtctcccctgccccaatctctctcttctgcttggacactgggtctccaagcccagctgagtgttcagagcaagacactcactccctgctccccagtccccactgcttcaggatcctggttcattctggcagcaaatctctgcccatctcagtcagctctgcaaactcagcctgctgcatcctgcataagcagcccagcatctcagcccctcctcccccagccaagaccccagcacccactccaacctcaacccagaagccagggttcaagcctggtccaaaggggctccagtcaccaagctggatagccctttagacccaaaccaactgaggagccagctctggaggacagtgtgtggggcgggggggtgtcaggagcggcacattgttcggagatggcagagccagacacgagatcccagactagatagagctgggaacgaggaggggggctgggcttggcgttcctgggtggtgatgccatctccccggcaatggagggcggcaggcaggagcctcccattcccccagaggacttgtcctccctgctatctgatgagggagctgtcggttacaggaaggcaagactgttcacaggacagctccagggagcaggaaattaacccaccagccagagacagggggaggggggctgggcggggcaggtaattaaggggccctgcaattactgtgccttcaatctgggccagagttctcaggaaggggatggagatgctgctcagtcggaggccccagctgactctggcagggggcatcagccctgtctcacactcttccttccgtttccattcctgtctcccctgggccccatccctacctctgtccaaccacaagtgatccgctcattctcatctttgcacaactgttcctcccaccctaaaggcctttcccactcactcgatcctgcccttccatcggctcatgcaaaggactgttctccaagaagtcttcctggagcagtcatgtcggaagggattgctctgagctcacataacacagcccttttgtgttacgataagggaacagactcagagagggcaacgatcggtccagggtcacccagcagaatcaggactagaacctgagactcctgcatttgggactggattttttaccaccaccctgtgagctcactaaccgataaccagcccaggcgtcatcacatgccaaccacggacacagactgaggaccacagaagggtcaaggggcccgtcgcatttatccagcatctacttgctctggattgcggctggggattgggaatgctgtgaccagcagacacagacacagccctgcctttagggagtttaaggacccgccacaggatcacccagaggtatgttccaagataaactaagaagaaccttcaaaaaagaggccccaggctggtgaaaccttgtgacaaagacatttaacccaacctggggcccgagacaggcctctctggagatgctgggcctgggctgcaatctggagagtggaagacagcaactagatgaaatggagcagggaagaacgttccagacagggtgtctggcatgggcacagtccagcagaggaagtccagaatggctggagctctgagtgaagaggtagcctgagatccagcagggaggccatagggccccagcgatacaggactctggcttgggcatttgatctttatcctaaaagcactgcaaagccactgtagagttttcagcaagggaactgtgtacatagggaataccactggctgcagtatgaggaaagggttggaaggaaccagtgaaagcggggcctgccgagaggctcctccatagtccaggtgatggtggcggagaccagcactgtgccagcgggcagtcaaggaaggagtgttgagaagggatgtgttgaggatggaatctcccggggcagggctaggacaggggtgggggacaagctggggacggagtggagggagaggaaggagtcaaggtaaccccctccaggcttctggtttgtgcaatgagatgggggttaaccaccaagctgggggcagtgtgggaggaggggaaaaggctgagctgcagatgcttctgagagactggcgtccattggagctagagaccaggggtgagggggtaaggagacgccacctgggtcgtgtggtgagtgcaggcctgaagcagctactcggagccacaccttctctgtagctcctttagcacgacgggtgccgctgctcccactttccagaagaggaaactaaggctcagactggaaaactgcttacatagagttccacagtggcagaaccaagatctgccctccctgagtttttctcacttcaagctgcctcaggatgcctctctggctcgaacctggcccagaggagaaagcagagccacccacatacacagctgggactacagggagctttaagcatctgacaggcccttggtgggaagcttcccctgcagaggagaaaagggctaggaaggcagcctggagatgagcaagggccccacctccccatggtcagggccactaatctcacgctccttctgtgcattatacaaacttactctgctgggcccttcacacccaagaaggagtgctgttgctattcagtcgctcagcctgaactgataccccatggactgcagtatgccaggcttccctgcccctcactatctcccagagtttgctgaagttcatgtccattgcattggtgatgctatccaaccatctcatcctctgccaccctcttcttttgcctccaatctttcccagcatcaaggtcctttccaatgagttgggcttcacatcacgtggccaaagtattgctgctgctcccattttacagctggggaaagagaggcccagagagaggacagtcaaggtgagtttgtggcaaaatacagaaagccagggatgtctggtgccaggttcccagctcactctctccaaggactggaggggtttagtgagcagctaggggaggcagagagtgagaagccctgggcttaagggctacccagtccctcctatcccccatcaacccctcagtgggcctgggcctctggggtgcagacccgaggggatggggagaaggatggtattgagtctgccaggaagcttctgagagcctttgtggctacctgagcatccccactagcatctcttcactcttccacctgccctcacctccagagccaggcagcctcttgagcccaagcaggggaagggagaaggctgacagaggtctttccctgcccgcatcgtgcctgtctattcagttatcctcctgtcggggcctttgggggcagtcccgttggtgctggaccctctggtccctttgttcagaagagacctgaacaaaggggaccgagaccaagaagcagcagccagctcaggtggggagggaacaggaatcctgtggcccacaggagggtgactgctggcccagcctggagaaaccacacgctggagaaggccaaccctgtcctgtgaaccttgggatttgcaggtgtgatgggaagacccaactgcacagaagcagttgcttccctgcagaccccaagggatagcaaggagagggcagagcttagagggtcaaatatgtgtgtggggatgccgaggacaaggacgaagcagaaggggtcctggccagcagggggcgccagcgcaacagaaatccaagcaggtggtttgcaaggagcctgaaggccttgtctcaagtccggaggttaccagggctagagcatgatgctagagcacggaatgaagaggcacccactgatcagacctggctgttgaagcacgaccccagcacagggggcccggtatggtgtcataaataagagcccagccttcagaatctgcaaggacagatgagttggaatcctggttgctgctgtgcggccttaggcaagtcttttcctctctgatcttcagtccacctccataacaggaagatgctcattgcacttccagcctggggtcctggcgtgcagtaagtccccagtaaatggacaaagtgcttcataaaaaacaaagaatgcgttcagacgtcaggactggcaggaggatgcccacacccgccctccccccacccccagccactgacccagggtcctttaccttcccatacaggttggggtgggtacccacttccttcagagccagagggggttcagtgcaggaagaaggggcctcagggacagaatgccaggcaacgcaccagggatggagctgggaccttggccacttgacaggtttgcttcatttgctcaacaaagttatcaagcattcatcaagcacctgccccctggcaggctctgtaccaggcacagaagtatcaggtgagaaggcacacagacccaggcagtgacacctcctgctggccccaggcgggtggggccgggttctgcccctcctggcttgcgctagttggacacatcctggggccacttgagccacaaggccccgctactgcccaggtaagatgacctgtgactcagcagtcaaaggctcttgaaggctggaggtcagggagtgggctggcggcagaggtgggcatctcccactcttgtgctctcttccctgcaaaggccgctgcttgcagagactctggagctgacaaggcttggttcacatccaggctttctacataattcccagggcccctgagggagtcaatttctaccctctcagccccagatgccgctaggagaatacaggaaacactttaaatgatttactatatgatttctctttctctttcataaagaaagctcctctgctacaaactaaccctgtgaggttggtattggtacccagctatagcaaaggaaaggctcagagaagttaagtgacttgcacaagatcacacagtatatatcaggcccatcaaactccaaagcctatattccttctagagcacatactagctcagggcagattgattgttccttcttgataatgggctcatctgagaccaaaagaatcctcagttcgcagaaagctgtcagtgatgaagggcccttctggggtcctgacccccaccatcagaagcctaaggtcttggttgataaccctggcactgttgcagactggatgacctcaggccaggtcaaggtccaaagctcataccaagccccaggctcccgctcctgaaatgcaggggaggagttaagcattggacacagcattcctggcctttctctgcttctcacctccacctgctccatcacacagactgacccccaggcttccctctccagggaatccatgagactagcccacacaaacatggcaagaagctgctctgctgaaaggtgctgcaacttctcagaagcatagtgcctgcccggggctgaggctgcaggagctcagctgagatgccttcctgatgtatcttgagtttcccctgaggatttcctgcaggtcctcgaagcagaccttccagctgaggaagctctgcatctgggaacacaagagaccctgcgtctgtctgggcagagagacgcagtgggctgaagtcttccctagcctgttctgggcttatgtcttggtcgctggcactgctggattctcctggccacaaaggaggtgagaggctcagctgaaattgtaagggactcccagacctgagatgctccaattgtaattaaattccctgatcaagccatcagataaactggattgccttcacaagagcacagaatcagccagctataatgccagacccacagctcctcttccccagcctgcaggatgatccagcagggggaaggtactgtcattaaaaaggactttggggagagaacaaggaagaatcagatgtggaagagaactgctaggacgccccacagccaagcctgaggtcagacggcaagtgcccgggaaggaattcctggcaagcctgcgtcctcatgtttcaccaagacgtccaatgtgcctcagagaaggacaacatcagtggctaaacatctcttttccaggtgggatctggcagctggaaaacctgtgctgtagccagagtggtaccctgggttcttgtttgcatccggagcagttttagttgcataaaaaggaaggtgtgtgtgtatgtgtgcgtgcgtgtatgagggtgtatttccccctcagtataacattattgctggttaacaggataaattgggaaaatgcaactacaaagcgaaaccacacagccctgtctcccccaacactttcagccttctagtgacttctgtttgtcctcgggctttagaacactctctgctgtctccctcagcacagttaagattttaaagtgagcattttcctctcactctgagcccttcctctgcccaaaggctgctccctggttcacagtcttaaggtcgtttccatcttctgctattctggatacgcctaccacaggtgcctgcatgtgtgggaagcttttcccacgttctgaactatcccctttggatgaaggctctccatctgaagatcctctttgcaggttgattcttggagcctgtgagagctggagaccatgcctcccaacctgggagccctccacgttctttgtccccaaaatggccagagggcatacctgcgagaatttcccttctgctcaaggcccacagggatgcgggtgtcaccccagtggccctgaaaaggggactgaggctcctgaggagacaggttctcgtttgcttcatgtatgaaaaagcagcccatcagctggagatttctctttggggttcacggtcagacgcatgggggtcttgtctctgtcactggctagctgtgtgactttgggcaagttacttcccctctctgagcctgtattctcatctggagagtggagatgataatggcacctacttttctcgagtggctgtacacatgaagtgcaatgatgcaggtaaggccttcagcccagagttggctacagcactgtaagtggttaacacattggaaccattgttgttactcagccgctaagtcgtctctgactctttgtgaccccatgaactgttggttggaaccacagatggctactttagctgcatagccctttcagtccaaaaggtgtcctctgacttctccgggtgttcatttctccagggctaaatgggactgaggatgatttctgcctcccagagttgccagggagcaaatgagcccactgggataagaaggaactccttgtcaactgcagagcgcatggtggtcatttactttgcttgttgttggaatcttctggtgggaactcactacctatggatggggccccaggggcagatctggctaatacagcctcctccaggaagacaaagcctgtctctagctcttcacaagctggctccaacttccacagaaaccccccatcccaacccccgggatctgggttcacacagcgctgaggtccagccctggatgcatcactcccatctgtatgtccacgcccactggcccttctgtccctcaggcttctctctgtaaagtggtggctccccttctgccttcttgttagacagagcaggtgagctcacagtgcaccccgtgggtgctcattcttcatacatttccttttccccgaagatccacaggccagagggccccttctcccagctgcctgggtacatctagaatcaccttcctggtgctctgcccgccatgcctgatgtgaccagagtgggggccaggctggtctgtgaaggtcagaggtgtggatgggctcggggtccacagagagggggagagcaaatgagacccagacatgccagcttgtccaggccctcccccaggtgaaggtgtagcctgggatgagagagctcttaggggggcggcaggaggcgggatacacagccctgccctgtaccagagctctcacagtggagagctgtggagtgtgtgagtgtgtgtgtgtgtgtgtgtgtgtgtgtgtgtgtgagtgtatgtgcacccagttcagtcgctcagtcgtgagcgctctgactctttgtgatcccatggactgcagcacgccaggccgtcctgtccatcaccaattcccggagttcactcaaactcatgtccattgagtcggtgatgccatccaaccatcttattctctgtcgtccccttctcctcccgccttcaatctttcaagcatcagggttttttccagtgagtcacccacctgcaattataaaaccagatgcagtcaggaatgtttcaggagtgctggggggctgtggcagaggtgtgggcagttgcccctggggttagggtgtggaggcagaggtgggcttctggaggagggcatacctatctatgggagccggtgtcttccagggccctgagaagcccctcccgacactccccttggtggtggctgcacagctcccgcccagaagccagaaactgaccggaagggcttaaggcagtctagactccctcccaaggagcccgacctggcctgctcctacctcctgaccctacccccatcaccttaccagagcctgggggccctgggagtgtggtcagggagctctccccacacccaatggccagggaccacgggggagaccggaggcaagacccaagaaggcaggcatgggtgaaagtcaggaagcccaggacccaggctggtcttcgtgggcgcctcctgcagacctggcagcctctatgcctgaaacctcacagcaccttccaagggcggtgttgtcatgacccccatcttacagaggaagaaactgaggcccgcagaagtgacagaaccattctcccaagccagcgctgagccttgagccccatctgtgacagagtgtggcacacagagcccctcaccatgacgctgctgtgggccagcttgcgagtcagtgtgcccacccctccccccgaccctgtaaggcaggcggcttcagctcccactaaacaaacaggaacaagaccccccaggggcactgccctctcggagtggagctggctgtggcaagtgaggactcagggcttttattgccatttcagacacacaggaaggtcaaagcagacagaggggatggccgcagaggggcctggggtctccccactgggatgcctcagctttgaccccacccataaggacagccatgtgcccttctcaaccaggagggcaggtgtgggaggcctccaggacatgagatgggtcagcagacaccacctggcctgatgagcaggtccacccagggtgacctcggcctggcagtcacagcccagtgccaagaggaaggcctgggctcgctggcatttccagaactgccaggcaccagggtgggggcctagggttggtacccatcacagctctcagctaatggctgagatgtcaatccaccctccaaagtcggtccaaaataacttaattagcttgaaagagctgctggcagcctgccaggatggggtgggggaagggtagcaggacgagggccccccaacactgcagggaagaaccttgacaggaagacaagagcacccccattctgtggactgtaccctttcctcatcacagggactcgacccaccatggctctgccaggtccagccaactgagcccactggacagatgaggaaactgaggctcagagggggccaggatgcgctctgctgtattcatggcagatgggcactttgaaagtggggtgatgctacttgggggcaggaaaagttcagccctagaaaagctggtggggtctctagggagagagattaaggtgccagcaacgtaccatcaagccagagggatcccaggttgacatcggaagggacttgaggctgcaggaaaggacctgagcctaatctggaagaaaagagtgtgtggcatgaggcagtatccaccttgagagtcccagcgctgggggtccttgcccctctggcagagggttttagccagagccaagtctctgatagggtggcacctaggatcccctgctccctgcagcccccaggacactgggagcccaggcatggcggtgatcgggtgcgatcagggtgagacagacacacagccactgccctccagaccctgatgctgccctgtcagtgccaggctgggcactgccccaggatcacaggcaagggatggctgtgtgtgtggcagcccagagaggaacatgggacgcccagtgagctggagctctgccccaggtgtctgctccaaggctgagctcactactggtcccactggacacttgctcctcccacctcagagaatacactccgtcaaccacccaggttcccaagtcagacactggctgtctccctcctgctcaccccacccccagtcctgcccaagtcacctcccgaacttttgtaatctatctatcctgcaccctgtcccccatcccacccaatccagaccaccactgtccctctggatcgctgccaagtccttgtcacccatttctctggtctgcacactattctctctgtctctctctcacatgcatgtgccccatgaattatcaagggaatctttccaaaactcaagttcaaccaggtcagcctcattgccctccccaacctggccttggagactggggggattttcccactcacctcactgaggttggaacagagcaactgaaaccctgggctccagatcagccaggtctgggtctgcatcctgggtgggccgtttggtgactgtgtgatcttggatgagtcacaccaccttcctgagctctttcctcacctaggaagcaaggctgccacgaccttcatcaagaagaccccatggggcaccagggtggggccatgctgagcgcccggctcagagcagccacaccacgtggcaccaacgggcaccggccagctcccggctgcctctcaacacccgcctcacgtgctgcaggctgtgacctgacccggcagctggtcctccctctggctccaagagccccgtaacaccttgctctccacctatcggttctctggcctgtctctacctgtgagcaggagtagagcctgggacaggctcgatttacatttgatgaatgaatgaatgcagtacgagtgtctacagagggacacggccacgtagagaggcgcacaacacacacagccacctgcggctcagacgggctgagggccagagggggcccctaggttggtccattattacacacccctcggtgcagcccagctcagcttgagcctaagaagaaagctcaggacctgttttctgagggtccacgagggtgtgtgccctgcctccatcacgaggcatctgagcctaccacactcgggactacaaggagcagcccagggggccacagcacccccctgggcagggctgcctaaagtgggggtgcggggtggagtggtggctgccagctggcgagcgcctgggcctggcagtgccgccgatcgcccactcgcaccagctgttagtttccatggcctgcccaccagctagccaggatgctgggcccgggctgccctggggtgtcctgccaggaagaggcagcctctaggagggtggcctgggcagaggggagggcagaggaggggcaggggaggatgaggatgccaggctggaggaggccagggccaccctccgctcacagtgtggcccggaacaggctgccgcacttccagcgcctcaggcgcctcttctgggcagtccatgaggggccggaggtggggatggtgcccagggctcctccctccgctcaaaacacccagcaacagggattctggaccctcgggaggggaggtgctccgaggtctgcgaccacaagagggcgcccgagcctcaccttgcagggagccaaggcctgaggcccgcggtggagctgtgcctgggagagggcctgggagctgggactgaatccctgggcgtggcatgcagctacctgcgtccattctcaggcaagaccccatccacactttagctcttttttcaactgatggcaacactacctgcttcagtatacgtctgcagagtaagcgcaggaacacgctgctgctaagtcgcttcagtcgtgtccgattctgtgcaaccccatagacgacagcccaccaggctcccccgtccctgggattctccaggcaagaatactggagtgggttgccatttccttctccaatgaatgaaagtgaaaagtgaaagtgaagttgctcagtcgtgtctgactcctagcgaccccatggactgcagcctaccaggctcctccgtccatgggattttccaggcaagagtactggagtggggtgccatttccttctccaggaacacactaattgaatgataacggtgatgtagtattttaccgatgaagagaatggactcagagaggtttagtgatttgcctaagtcacacagcagtaggcatggagcaagttattccctctggtgctgggtgctggcagagctttggaaagagtcctggcaccaactcacagggggttagcagcactcaagtcctcagggtagggaccaagcctgattctggctcccccaggtcaccctgtgccataaagaccagacccttttctgggcaattacattaatgaaaagaggtcccagctgtgagccctttacacacccatgaggcatcctcgtcctctgactcacagatgaaggaggaaggcatgagagaagttaagaacttgccagaggccacaaagcttagttccagtactttggccccagaatccaccctcccctcaccatgctatgtcctggggaaactgtttttcccaaaggagcttctggccacctccgtccctctcctgttcacccaacagctttcccacctattcagttggggcagaggtgaacaccaggcccggccccatggaccgaccaccacccaaggggagacagacaaggtgcacatgactcattcagggccggagggcccctaaccaatcaggggtgtcagggtcttctgtggggaggcaaccactgagctgagttgcaaggaaaaaatgtagcacaatggcccttgctggcctcccattctgggcccagggggagctcgtgagttgggagaaactggccctgtgtgggtaggaggagtgggcaccccaagggcgagtccaggctggttcccagcaccctccagcacctggtcatcacaaagtcatggtgggctcatcaaggaatcaccactgggttgtgattggttatgggtgttcatggagccaagccctccaccagccttcccgcctttctctcaggatgggtaccccctagggcttcctcgattctatggggaccagagttggcggggtcaccaccctctgggtacaccgggcacagaccattgggccaccaacgcagcacctggagcccagagctcagagtctgagcagagcctggctggagggattgggggcaccagccagggtcccagcctgctgccttttgcatcaccagcctggagcccagcccagggccggcacctgtgcctcaaggcaccttgaggacctaactgcgcccctctgagaccctcttcccctaatggggcagtgaaagcacagccagccccagtgctccctgaccctcctggtctctcagggcctcctgtgtggttctagaagcaggactcaggctgtggcagccacctctctccaccagtggccaccgacactgaggtgcagagggagcctgggggctgtgaaggaggctgctccccctcatcgtgccagcagtggtgagaatcagacttccccgttcaaggacccccagctgatgttctttgtacccctgtgcccagccaccccctgcccctcagttctggggtccgtcagcaccaacagccctctcctcctctgcactctcccagccatccccaccccggacattgcctgcccccagaaccgccccctgatatttcccccctcccacccaggactggcttctctgtccaccatcctccaccctccctgttgggctggcttcactctcctgaccccgctctctgacctcatctcacccccctttcctcctcctggactccctccttatccagcctatatcccaagggacctttctgcacccagagtctcgagcacaccgaccctcaaaaatctcccaccccattctgcaaatgcccagcctggggcagacccacagtgctcctcctagaggatcccatctgtccccaggccccagggtccccctcccttgtctctccccacttcttccttccatcaagaaacacactcacctcttgataatgatctttcaagctgctctcttagccctgcacatggctccaactgggccccattccttctccccagcctggtggagctcttcaagcgttacttgtgtgcccatctctgcctcctcagccccctgccctctgcaccgcagtccaccaaaactcttctcatccgtcactcctgctacatcccgagagagttgggttcccatcccaggctggggccagagagctgtgccctgctctccccctcttccctgccccctgctcgtctccatggccccacgccctagtgaaggtcccctggctgctccttactcccccagtaggtccttctgccatcctgtcccacagacgacggagctctcttctagccccacatgatcatcccataccactgccccctcttacccggtaccaatgttcccaaactcgccaaggcctgtctccacgcccagggatccaactgcgtcttcagtgtgggtcaactccatccaagtaacttaatcgtgacacagtaacttcatgaaggaagtactattattatccccaatttgcagatgggggcaccaaggcacagagagagttgcccagggtaaacagctgatcagcctctgaaccaaggtctccttcctggagatccctcaagagcctcagattcaccataaacagaacaagctcacgggctctgcactgaatgtcttcttcctggccaagctggcctttggactggacagtgacaagcgtctggaccgtgggcaattttactttctgtgggaagtacttaacccagagctcaacagcagtaagtggccagtacaggccagctgctgttgtcaccatggccctccaaacctcagctgcttctagaagatggggctattgggggaatgtctgagctcagggcctggccacacgggggagactatagccctggccactccgcacaagagcctttttgcagtaagtcaaagcagcatcaatttataatgctgcaagtttggcacaaatgcactatttttcttaagccaaaataaagctccaataagctgtaaaagccctggagttgggaggattctctgcggggtcatttagggtgagttagaacctgcagctgtgaactcctcagccacacatggcaacctgggtgggtacaccccagaatgctaatgaaggcagctgctcagggtcggggagccagctttgctctggcttcaggccccagggagagggaaagccatgtggggtgagacaggacaggacctcagccaccctgggctgcgtgatctgggccaagcccgggccccactccaagctgcagcttcttccgatggggttccgaagcatgactcagaagagggaagttcagggcctggggtggggacttcgaatgatgtgtgcaggcattttcattccttgggcagagatctcaggatttgtaatagtgttgtaggaaaaatgggattaaacatgccaatatttgcttatgtacacaaccgtttccataaagcaggattgtgccccatctcaatggaagcaaccccaaagtccttcttgtttggggcaggtgagcatatgggaggctggatttgatcccaaactctgccctttgccaatcatggtctccccaagggacggttccccttgcccgttccacaggtgaggagactaaggcctgactctaaaatgcagcatcttaacttgtgtatatgcatgtgacccagctcccagtctctctgacctctggcttggtgaggtcacctctgcccgaggccctgcaccctcccccaattccctggtgcctggcaaagaacccagatcttgaaactccagagctcagctctgcacatacaagttcacgatcagaaacaagtaggtaccctctctctgggcctccgtttcctcctctgagccttggtaaaatgagggtgatgatggtagctaccccaaacagttaagctaattcatgcaaaacacccttgtggtgcctggcacaggataagtgctcaaccagcattcaatccgttcaggagataggatctatgacttctactctgaagataagtaaacagagaattggagaggtttggccacttgtccaaggtcacagagctcaggagctgtgatggcagggggagggtgtgaggggggcacgagctgaggctcaaaccaggtctccttgtccccatcagggtccagatggaaggggagtcaccgagccaaagcccccagggcagggacagggagagaagggaaggaggagagaaacaggaaggctaccaggacagagacgggaccgggagcaagctactgcctggggcagagggcccaagcccgcaggggtcacggggcacggttccccgggctgacagtgggcactctcaccttcaccctgttctctggtggctggtgaccttgacaactcaacctgcatcactcacatcctagtaaggccctgaaggcagacgttttgggggtggctcatctacatgacagcctcccacaccttgagccagagccagggtcctgccccctcccctggagttcaggagcaccctgcccacccaggggctcccattctgggctgcaggggcaggaggtgagccggagccctgagaaaccaacagcctacctacctgaggtgacctccaaccaacctcaagacctagggcacctagagggtggggggagcctccacctacagcagccagcctccatgtgcccacccgcaggcctcgcccatctctgctgacagctgggaattcctgccgtgtgacccagtcagcctttcagggctgggatcctggcccagccacccagacacggttatagctcaggctgtgagctgcctatgaggccagggcaagtgattcccatctctgggacttggcttctccaggtcagaggagggatgagctgcgagctgaaacaactcttcccacccagaggatctcgggatctggaatcccagaagccaagtgttggagagaacttcgggctgcgatttcctaacactggcctgcagcctgacaaagtcagggtccccggggagtcctgtgaacatgtacacgcgggggctcccttccacccccagcagatcagcagatgcggagccgggtgttctgcagatttagctagtgccctgggtccatgccttctgctgactctcaggggtgggggcaggggaaggaaggggagggtggggctgagggttcttcccgagacaaggtgcccagggatccctgagcctcccaaaatctttactgcttcatcccttgagtgtcctcagaccccctcccgcccgccacccagggctggaatccagcctttgctcccatcagcaactcctccacagaattctccaccagcttctccccatcctggtcctcttcacccaggagaggccacagctactggcccttccagcttcccctcccactcaaatcaggggcctgctttttgttttcttcctctcaagcctgcataaagaacactggatttagatgaacagctctgtgcacaggccctgtctgggccccatgtaactgccaccctgttgagctctaacacatttcctccaccccaaagagcccccagtcaagccccctgctcactgcacctccccggcccccctcagcagacctctagccccacagattagaagggagaagcctctttctaagcagctcttctgtgctcatcaggttggactgaaacccctgaggacagcaactgggctgtcctgctggctggcagtgcctggcacagagcagacattcgggaagggctgtgagaggaaggacaaggtggctgcaggctgcacccctgctccagctgctgccgtgatgagtctccttggctcatcatcccagcttccttcaatgtctaccacactctcagcccccagccccctgcaggacgcctggcacatggacacgcaggtgcaacacccccacctgccccggccaggcctctgtcaatgctcagacacctctttccccacagggctcctgccccatccccaagccttggctcccagaatcctggaatcacaggcacaccgaattcctggatctgcactctccccagtgcctccagcccctacccactctggcctcacttgtcctggcaggctgtcttctgtccctgtcccagcaccgtctcagcccccacagcaactcagagcctccgcactaagctattagcaggaagtcagctctccctcatgcccacaggctcccgcatgtgacctgcgacgagcaccctcccctctccaagcctcagctcctccgtctgtaagacagccccatcaggctatgtggattcagtggactcttctggctctgatgtttcctgcagatcactgcccacggttagtgtaaataaacatttattagataaataactagccccaaagaatgagtcatcattgatggtggaacggtagacatcagctgcaggccacttagaggcagaattcaagagtggtggtgaaagctggattcagactgcctgggttggaaaccctggttcacgacttcctcatctgtaagatggagatcacagtagggcagggtgaggatgaagtgcgatagtgtacagaagcagccagaagagcacctggcacttaaccagcgctcaggagaacttagctcccactggtacccccagcgccactgtccctcagcaaggctcgggagtccacatcagcgacctgcgggtggagccaagcgtagcagcagtgcctgactagtgccaccagagggcaccatgacgcagccaaagccgcccagctgaaccgagggctccctgattcatcctgagtggcagtgccagccagaagcctcccagctgggaggacgagggtggggcctggatgcccgaggagttctttctgcaggagatgcccgcaccaccttggcttgatattctgcccattcctagcacagtctgtgaccaacagcaacccaaagtgtccctaatccttccctccagagccatcagacccatttaacagatgaggaaacaggcctgagagaggccagctccaggtcatgaggtgaactctggccttcctgctcagactgacctcccagtacaccccactaaacactatgggtgtggcgcccacccccacaaccaaagctgggagccagcacctgtgcccacctgacactccttgggcagaggagagacaccagggaaaaaagcacatctaatggtggggagacctcaaggacggagggcccggggaaagtgctggatgtgagaggaagagacaaagaaacacgaggcgaaacagggtggggtgggcacggaagacaggagatgcaggagagacattcgagaaagtgaatgggtggaaagagacagacaggggaagaggcacagagacagagaatcccgagggagaaggcaaagagagaagcagaggcagaaggacggagacagaggcagagggagcgattgaggaaaagagagatggggatggggtcatggtgacagagagagacgggaggcagacccagggacaaagacctgtgggcaggggaccctggagggccaccgaagcggcttcactctggtctggagcccccatgccctcctcccaggcactcagccagagctctcgcccttgcatttctgtcacaccccctaccccagcagggcttgccagacagacaccccctcttgggggtggtggttgagccgggttccctagggcatctaaggcagacaggtagggtccctggggccgtgttgctaggagatccagcccagggccccagcctatctcctgagcctctcctagggcaaggctcaacactcacctaggggctcacctgagacctggattccccctagctttcaccccgtctggccctggacagcctctgccctgcatcctcttggcagagggaaggcacacctggtgacccagccggttgccaggcctccctggctcctgccccaggccccggggcctgctgtgttccttagaagcactagattcccgggcttgggtgcaggtggcagggagattgttcaaatctcagcctgccttttaccagctgtgtgcccctgggcaagtcactctccccctctgagtcttatctttaaacaaaaataataacagtatccattccatagggtcctctagaggaggaagagccataatgagggcacagcaactgggatgggagactggttttaagctccatctctgagccacctgggctgcagctgggagcatctccccgcagtccctgtctcccctttgcacctccttgagcaggctagagtctgattcacagcagcctcaggggaaggggctgcccagagccctcccagggaactcagataccaggagacatgaacactaggggcccaggcaaaaccacacccacatggttgttcgggcctgtgtgctgctttggggccttagatgaaagcaacttcagggcttcccaggtggcgctggtggtaaagaacctgcctgccaatgcaggagacataagagacatgagtttgatccctgggttgggaagatcccctggaggagggcatggcaacccactcaagtattcttgcctggagaataccatggacagagaagcctggcaggctacggtccatagggtcacaaagagtcggacatgactgaagcaccttagcaggcattcatgtaaaagcaacttagcttccaggcccagttggcctatgggcaggtctgaccacagtctccattttacatatgaagaaacagacgcaagagctgtgcctttgcccaagttttcaccaacaggtctgatgcagctgatgcnnnnnnnnnnnnnnnnnnnnnnnnnnnnnnnnnnnnnnnnnnnnnnnnnncctccaggctgcggctcacctcagtcataaatctgaggctgcagtgctggccaggcccctggcaggcggcagggggcagctccagggagcattggagcacgccagcaagaggagtcccttccccagccaactggaactcccacttggaggggatctaagaactgggcccccagctaaggcaggggcttcaccaggatactctgggattccaggacctacacactgggcattcagcccaaagtccctgacctggggcctgttctctgcctgtgccacttcattgcctcggatctcagcagtgtcagtccaaggcggtgtgtgggttggagggggttggagcatttatggcttcatgccttccaagtcagcccatggttttgtggaaatagatacttgaggtcgaggccagccctctcccaccctggccccctgaaccctgcaaacaccttgacctttcacttaaaaatgtaatgagatgaaagaggccagcaccatgccaggctgccagcatgagcccatccacagatgccagctcccttccattccctctctctccccactggcactgggcacagagtcaggctggtcaggagccttctggatacttttccagggacactgggcccttggccagaaatgccttccctgggcctcaggagatgggtcctaggagctgaaaagagaaccagaggggccattgggtgggatgggatgggggggccacctggagtagggggacacatgtgtcagccacgtgtctggatggcttcctaggtgaactttcaaccagcatcgcccaccctcccgctctctggcatgtgggtctcagggggctcctgatgcaccttccactgctttgcctcccttccccccagaccgggacaccctccaaagtgagctcaaagcctggctccagctctttctagctattcaacactgtgcaagtcacagggctgtgcatgaggctgatgtaagacaaaggggcatctgagatgcaggtatgatctggagaccggtgtggtcctaggtctcaggctgtctgtgagagaccataggagagtgtggggggccatgggcagaccagctgggggaagagggatgtgagtatgcaagtgtgtgtgcatgttctcacacttgtctctgtgcacacatgtgtgtggtgtgcttgtgtcatgtgctcatacatgtgtgcacatgcacacacgtgttgtgtgcatatgtatgcacacatacgtgtgtgggcacatagcatgtgtacatgtgcttgtgtccatgtcatatgagtacactatgggtgtgctctgtgcacacgtatgtgagtgcaagcatatacatgtagcgtgcaggaacgtgttgggggcactgcaggtgggtcttcctggcttccctgtgtccttacccactttgattccttgccttctccctccctctgtcttcctcagctcccaccgctccctgcttccttccttccaggaggcccagctgcctggtctccagacagtggcccgggtggcagtgagtgggagctgatcacactacgcactcacgaggaccctctaatcctcttagctcccactgaaccccccggccccccggtggagacagcccatgcccaaactcagctggcctggggtcaccacagcagaggctcatgggctcccaagctggccctcagcaggttaattagtaacaatgaaccccaaatcctcactggggcttcagagggatacttctccatcaataaggcccttttctggctgtgatcccttttggtcctaacagtctcttttgaggtggggatttgaattgcacatttgatggtgaagggcattgaggccttggagagggagggggcctttctggagatcacacagcaggtcagtggcagaattcactcaactcaggctgctcccacacctaaggcctcacggaaggctcctcccggagccccaaccccccaaaggggtccccgctctttgcctcctgcctccacccaccatcccaggtttcctggaatctgactcttgagagacctaccttgcctccgtccatcccttggggccaggggtgctgctcagaaccacctggtaacagtgcagcctgcatgccagttccctgtgctgccattccagagctccagtggctcgttggtcacacagcagtcagacctatgctaatctgctcttgcagtgggagcacagagagctggcatcaccccccaacaccccacgctcccccgccctccctgtccacatcagcacctctgctttctcttcactcacagcacccagaccactctggtttccttctgacttcccatcactcccacggttttcttcttgtaggttttgcaccctcagacccttgggcctgcaatgtctcctccagaagctcttagtctgcctgacccctcagtgctgggcctcagtgtccctgccccggagaaccttccccgactcccagtctagactaagcatccctgccatttgtctccaaggcacatttcccagtgtgcctgaatacatccccttacgtatttatttgcttcatataagtctcgccactagagcataagcttcttgcctgatgtcatgggaactcatatgtccctgtatgtccaacataggtcggagagatgctaggagcgtagtagagtgtaagtaactcctcagtgaataaatgaagggaggagagatgaacaggcaggatgttcctcctacacgcctgcatgaacgaagagctatggggtagagagagctgggagagctgctgggtctggcagaagcagccctggttaattgctcaccctccaggaggaggtggggaatgggggttcacacacacccccagccagctctcagagaggtcgtttggcctcaagtccccaccctctgcccccggctctgggctggatgcctggcctctgcctcctgagggctctcctcctttctctgggcacccccaggggacaaggcccgtttcctctgggcccatgtagactctgattctatcccaggctggggtccttacttgctgtgtggccccggcaagtccgtgcccatctccaactcagctttctcacttgcactgctgctgctgctcctgctaagtcgcttcagtcgtgtccgactctgtgcgaccccatagaccacagcccaccaggctcccccgtccctgggattctccaggcaagaacactggcgtaggttgccatttccttctccaatgcatgaaactgaaagtgaagtcgctcagttgtgtccgactcttagcgaccccatggactgcagcctaccaggctcctccatccatgggattttctaggcaaaagtactggattgggttgctattgccttctcctcacctgcactgcaggggagttgaaaaggatgatctctgtctgtctagcttccaaggaggcctccgactgttacctccggtattcacacccctgtgtaatcactgaagagactgaatcagtgtaacagatggagcggcgtgaacgtgagagtagggctcccgaagcacaggacagggaggctacgctgctcctctgatcacaggctctggggaccccagtcgccatgtggtaaggatactcaagcagcccagtggagaggaacggaggcttcccaccaacaaacagtaccaaccagccaggtgagggggttagtcaccttagaagcagatcctttatccccaggcaaatctgcagatgaccccagcccctgaccccagccccagccaagatcttggctacatgagagaccctgagccagaaccactcagctaagccaatcccaagactcctgatccctagaagctctgtgagataataaatgctgattgttcaaagccacaaagttttaaggttactggctacacaaaataaagtaatgaatatatttccaccttctgctgcctacccccagagttctggtctgaatcattggtctttcagaaaagccctaggttggtgtcaccaatgtcaaactcaactaagttcagggaggagctcatcatatccccccccatctacttccacaattagccattgccaacggacgtcctctagaatcaaagacagatacgtggtgtgcattattgttcagtcgctaagtcatgttcaactctgcagctccataaactgcagcgtgccacggttccctgtccttcaccatctcccagagcttgttcaaactcatgtgcattgagtcagtaatgccatccaaccatctcatcctctgtcacccccttctcctcctgccctcaatctttcccagcattaaggtattttctaatgaatcagctcttcgcttcaggtggccaaaggattggagcttcagcttcagcatcagtccttccaataaatattcagggttgattttctttaggattgactggtttgatctccttgcagtccaagggactctcaagagtcttctccagcaccacagttcgaaagcatcaattctttgctgttcagccctctctgtggtccaattatcacaaccatacatgactactggaaaaatcatagctttgactagacagacctttgtggtgtgcattattgccttccttatcccagcattcagccactgacaaacttggcctcttttatctcctgcccatctctagaatcctccctctctttaccaagcctaggtgccctgccccagctcaggccacaccctctcttgccagttcagcggctcctctctagtctccctgcctccatccttgctgctcttaccacccatccatcctccacactggccgctagagggagggacttcctaaaacatagatctgatcatgatgctcacctgctcattaatcttccatggctcccctgttgcctaaggcccgaactccttggcctggctttgaaggccttttttcatctgcccctaccccttacctctccatcctcatctctagtttttctttgtctcagtgttccattgatactgagccacctgcaattcttggaacacaagagtttcatacttccacacctttgctcacacagttctctccacctggattcccctccccttctttacctggaaaattcctactaatctgtcaagccctagccgtctgattctccgtgaggagctggtctctcactgcatcttattggactacaacaaactgtttacatgtctattcacccacaaagtgacaacctccaaagcaggatgtctttttcatctctatattcctagtaccttgctcagtcccagcatacagaattccataaagttcttaaaatggaagacctttagattgaactttaaggtcaactcatttaaaaatcattttggatgggaacacctctaaaaggtattacagactctcctacctttttaaactagtttatgggacatgattgaaccttgctcgagtgtatggtttatgtcagtacaaaccccgggtttttcagaaggagccttggaggtcatccaatagaggaaggacctcaggtctggaaagatcacgtgacttgcccaaggactttgcatgacgaacgttaatgaacatctgagctgcaagacggtgatctctttgctttgatgaaggatgtcaagcccttgccttgccacggcactaaatggcccctttagtcaatgtctttaaggtttctgtatgttttagaatcatcccatttcagcactaggccagtgtacctggcccccactttacccctctagtttgttacttctggtccactggaggcaggaggatcaggtaaccaaacttgatggaatcacacggaaaggaagagttacagccctggcctgagacctgggagcactgctcctcgggggagtgtggcgggacgatgggactttgtggccctcctgcctctgctgtgccccagatatgacagttgtcgtgaggagagactgaaggcttgggctggttctggcggagggaagtgtcagcataaccaagagatcctgcaggcaattcactcccaggtagatgactccacagggaggacaaagaggcggatcctggaccctgggctccataagctcccttcccacactccctcatcagagacaaagtgcatagtgcaagaggcaaaaggaagcagggcctctggggtggggtggggagagggggactggataggtgggaatagctctgtttatcttatccagcgagcaaacgaatgagggtggaacaggaagcaatgaactaagagatgaggattctagtccagcttccactactaactggatgcatgtcaaggggcaactcaactagtcaatctaggtgtccgtttcagaatctgtgaagtggggatgtgtgtgaaagttttagtcgtttagtcatgtccgactctatgccactccatggactgcagcctgccagactcctccgtctatggaattctccaggcaagaatactagaggcggtagccattcccttctccagggatcttcccgacccatggatcatacccacatctcccacattgcaggcagattctttaagatctgagccactagggaagccctgaaatggggataattcctacatcatggggttatagtgggattaacaaaaataatgtaaaaaagaacttagttctaaagtgctgctcaagggaacatggccttcattcacgcattgcacaaacacttactgattacctactatatgccagctgttccaggaactggggctgtggccatgaacatgacaaagcccaggtcccatggagctgactttctggggcgggagacacataaatgaataataatgtactaatcagtatctcaataaaggacagaaacggtatggacctagtagaagcagaagatattaagaagcggtggcaagaatacacagaagaactgtacaaaaaagatcttcatgacccagataatcacgatggtgtgatcactcacctagagccagacatcctggaatgtgaagtcaagtgggccttagaaagcatcatgacgaacaaagctagtggaggtgatggaattccagttgagttatttcaaatcctgaaagatgatgctgtgaaagtgctgcactcagtatgccagaaaatttggaaaactcagcagtggccacaggactggaaaaggtcagttttcattccaatcccaaagaaaggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaagaatactagagtgggttcccacgccctcctccaggggatcttcccgacccagagattgaacccacatctcctgtgtctcctgcactgcaggtggattctttacctgatgagccactagggaagctcctggtgtctcaggaggtaaagaatctggctgtaacgcaggagacccaggttgtaggttgggaagatcccctggagaagggaatggctacccactccagaactattgcctggagaattccatggacagtggagcctggtgggctacaattcttggggtcacaaagagtcgaacatgactgagcaactaacacttttcactttcaccagaacagaccggccctgcctcaataaaagatgagactctttcccagtcatagcaagttcctgaatttcagtccacgccttcaatcaaggctctagggacttttgttcattattttctttccttaagctatccagtgccattaaaagcaaacattccaccccacagtcctcagagtcctcctgccctttattcttctctgtggcacaggtcgtccaagcccctgatggcttgccttccatgggtacttcattttaggtgaccacaagggacactttaattagctgtttcagcactggggaccatgggcttctgggtctcctccctttgtgctagctgttatctcccagccttcagccctaactagggcaggagccaatcccagattcccaggattccctcggggtctgtgcctgcaccccaattacggcaccaagatttgtactaatcagggtacttgtttgcaaacaacagagagaaattctgtttgacatacactgaaaatacacaggcatcaggatgttcatcgaacctgtgcagaagccagaagaccaggcaggatccagagagacacagacgaggtcttgccacaggaatgatacctcaggagctgctccgggggtgtcgccaccaacctcctgtcccaccacaatgatcctcagtgaccctgcaccttaggccactctttctgttgagcagtcgagtgtgagtgtgtgtgtgtgtgtgtgtgtgtgtgtgtaggtgcatgcatgtaggtaggaagagaggaggaccagcgagtagctagctctcttatgggatttgtagggcaattagcactaaattagacgtgacctatgccaggctgaaatcccatctctaccatcaacttgacccagttgtgttatcttgagcaaatctctgaccatctctagacgggcctcagtttcatcatctgggaaatgggaacaatatccattcttccagcctcactgacgtgttgtgctcccacaccctccttttctcatggataggacttagttcaatgtataacgagacatttatttgtgaaggtaccactaatgttcctccagtagacggtaggctctgtgaggtcaaggacttcatctatctgcttagtgctgttaccccaacacctagaaaattgcatgaaatgtagcatgggcccaagaaatatttgaatgaaagactaaacaaggtaaaggatcaggaaggggatttgtaaatcgtcaagggccgcacatgtgtaagtgctggtgctttggagccagagagaccttgaaagtgaaagtgaaagtcactcaatcatgtttgactctttgtgaccccgtggactgtagttcatggaattctccaggccagaatactggagtgggtagcctttcctttctccaggagatcttcccaacccagggatagaacccaggtctcctgcattgcaggcggattctttaccagctgaaccacaagggaagcccaagaatactggagtgggtagcctatcccttctccagtggatcttcccaacccaggaatcaaaccggggtcttgtgcactgcaagtggattctttaccaactgagctatcagggaagccctgctgctgctgctaagtcactttagtcgtgtccgactctgtgtgaccccatagatggcagcccaccaggctccccggtccctgggattctccaggcaagaacactggagtggggtgccatttccttctccaatgcgtgaaagtgaaaagtgaaagggaagtcgctcagtcgtgtccgactcttctcgaccccatggactacagcccaccaggctcctccgtccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgtcttcttttcctctacacttaggggaagtcacccagtgtccccatgagttcccgccatcacctgcacaccagcctcagcaggggccccctgcccaagactgtctgggagtcatctgccccaccccctccctccagctactccaggacttactccagaactgcagttacacctccttgtctggaacctcgggacctgacccaagacccagcctacaatggaggtttaggaaacaaatggataaatgaatgactctctgttttcaaaattataaaaccaatctctgtctttgcttgaggacagagtctgaagaaatgacctaaacccacagaaagatgcactaaaattagaccctaacagaaacttccccagtcgtgttatttactaagccctacaggggagagacagagacgagggaggctttccttcctcctggggaaaagcgaggggctagggagaggaagtgagacccttgggaaagtatacctccattggcagggagctcattacttgttgaaacaggctcctccattaccaacttccttcagcaaccagagtccactcagtcctcatgtttctgatccctacccttcacctctcccaccatcccctctctaaagagagtgtgactttgcagagctggcagccagcaagcctgccaccattcccaaaagaagacagaccttcctaacagtagtggagcaggctaactcagaaggtaatcaactcctcgatggtggaaatggacacagacctgccaagagatctgtctttgtaacacaacctcacttatgggagcactttaagcttaaccttctctcttggccatttgcgctgggttttgaagccatttttccaggtaaaagctgaaggaagggcattcaagacagaaggaatggcacgtatggaagcatagagatggaaaacggccccatgtttgcaaaaagacaaatcatcttgactttcaaggccggaatgtggggccccaatatttactgagcacagactctgcacagatgcaggggtaggacctggagagatactgcaaataagacaaacacacagtctccactctcatggaatttataatctagtgggggaacagaaaagaaacagacaaataagtgtgggcagtcttttcagatggttccacatgctgttaaaaaaaaaaacaggtgacacagtggagaacgactggtggttggggagcacctctctgagcaagtgacatgtgagctgagatctgaaagcagcaaagagatagtcacgcaaagagcaggctgaagaagttcctagctagaggccagcaagtgcaaaggccctgaggcagagacaaacttggaattacagagaaacacaggaggccagtgtggctgaagagtagggggagagtacctggtgctctgctggtctcccctgccccaatctctctcttctgcttggacactgggtctccaagcccagctgagtgttcagagcaagacactcactccctgctccccagtccccactgcttcaggatcctggttcattctggcagcaaatctctgcccatctcagtcagctctgcaaactcagcctgctgcatcctgcataagcagcccagcatctcagcccctcctcccccagccaagaccccagcacccactccaacctcaacccagaagccagggttcaagcctggtccaaaggggctccagtcaccaagctggatagccctttagacccaaaccaactgaggagccagctctggaggacagtgtgtggggcgggggggtgtcaggagcggcacattgttcggagatggcagagccagacacgagatcccagactagatagagctgggaacgaggaggggggctgggcttggcgttcctgggtggtgatgccatctccccggcaatggagggcggcaggcaggagcctcccattcccccagaggacttgtcctccctgctatctgatgagggagctgtcggttacaggaaggcaagactgttcacaggacagctccagggagcaggaaattaacccaccagccagagacagggggaggggggctgggcggggcaggtaattaaggggccctgcaattactgtgccttcaatctgggccagagttctcaggaaggggatggagatgctgctcagtcggaggccccagctgactctggcagggggcatcagccctgtctcacactcttccttccgtttccattcctgtctcccctgggccccatccctacctctgtccaaccacaagtgatccgctcattctcatctttgcacaactgttcctcccaccctaaaggcctttcccactcactcgatcctgcccttccatcggctcatgcaaaggactgttctccaagaagtcttcctggagcagtcatgtcggaagggattgctctgagctcacataacacagcccttttgtgttacgataagggaacagactcagagagggcaacgatcggtccagggtcacccagcagaatcaggactagaacctgagactcctgcatttgggactggattttttaccaccaccctgtgagctcactaaccgataaccagcccaggcgtcatcacatgccaaccacggacacagactgaggaccacagaagggtcaaggggcccgtcgcatttatccagcatctacttgctctggattgcggctggggattgggaatgctgtgaccagcagacacagacacagccctgcctttagggagtttaaggacccgccacaggatcacccagaggtatgttccaagataaactaagaagaaccttcaaaaaagaggccccaggctggtgaaaccttgtgacaaagacatttaacccaacctggggcccgagacaggcctctctggagatgctgggcctgggctgcaatctggagagtggaagacagcaactagatgaaatggagcagggaagaacgttccagacagggtgtctggcatgggcacagtccagcagaggaagtccagaatggctggagctctgagtgaagaggtagcctgagatccagcagggaggccatagggccccagcgatacaggactctggcttgggcatttgatctttatcctaaaagcactgcaaagccactgtagagttttcagcaagggaactgtgtacatagggaataccactggctgcagtatgaggaaagggttggaaggaaccagtgaaagcggggcctgccgagaggctcctccatagtccaggtgatggtggcggagaccagcactgtgccagcgggcagtcaaggaaggagtgttgagaagggatgtgttgaggatggaatctcccggggcagggctaggacaggggtgggggacaagctggggacggagtggagggagaggaaggagtcaaggtaaccccctccaggcttctggtttgtgcaatgagatgggggttaaccaccaagctgggggcagtgtgggaggaggggaaaaggctgagctgcagatgcttctgagagactggcgtccattggagctagagaccaggggtgagggggtaaggagacgccacctgggtcgtgtggtgagtgcaggcctgaagcagctactcggagccacaccttctctgtagctcctttagcacgacgggtgccgctgctcccactttccagaagaggaaactaaggctcagactggaaaactgcttacatagagttccacagtggcagaaccaagatctgccctccctgagtttttctcacttcaagctgcctcaggatgcctctctggctcgaacctggcccagaggagaaagcagagccacccacatacacagctgggactacagggagctttaagcatctgacaggcccttggtgggaagcttcccctgcagaggagaaaagggctaggaaggcagcctggagatgagcaagggccccacctccccatggtcagggccactaatctcacgctccttctgtgcattatacaaacttactctgctgggcccttcacacccaagaaggagtgctgttgctattcagtcgctcagcctgaactgataccccatggactgcagtatgccaggcttccctgcccctcactatctcccagagtttgctgaagttcatgtccattgcattggtgatgctatccaaccatctcatcctctgccaccctcttcttttgcctccaatctttcccagcatcaaggtcctttccaatgagttgggcttcacatcacgtggccaaagtattgctgctgctcccattttacagctggggaaagagaggcccagagagaggacagtcaaggtgagtttgtggcaaaatacagaaagccagggatgtctggtgccaggttcccagctcactctctccaaggactggaggggtttagtgagcagctaggggaggcagagagtgagaagccctgggcttaagggctacccagtccctcctatcccccatcaacccctcagtgggcctgggcctctggggtgcagacccgaggggatggggagaaggatggtattgagtctgccaggaagcttctgagagcctttgtggctacctgagcatccccactagcatctcttcactcttccacctgccctcacctccagagccaggcagcctcttgagcccaagcaggggaagggagaaggctgacagaggtctttccctgcccgcatcgtgcctgtctattcagttatcctcctgtcggggcctttgggggcagtcccgttggtgctggaccctctggtccctttgttcagaagagacctgaacaaaggggaccgagaccaagaagcagcagccagctcaggtggggagggaacaggaatcctgtggcccacaggagggtgactgctggcccagcctggagaaaccacacgctggagaaggccaaccctgtcctgtgaaccttgggatttgcaggtgtgatgggaagacccaactgcacagaagcagttgcttccctgcagaccccaagggatagcaaggagagggcagagcttagagggtcaaatatgtgtgtggggatgccgaggacaaggacgaagcagaaggggtcctggccagcagggggcgccagcgcaacagaaatccaagcaggtggtttgcaaggagcctgaaggccttgtctcaagtccggaggttaccagggctagagcatgatgctagagcacggaatgaagaggcacccactgatcagacctggctgttgaagcacgaccccagcacagggggcccggtatggtgtcataaataagagcccagccttcagaatctgcaaggacagatgagttggaatcctggttgctgctgtgcggccttaggcaagtcttttcctctctgatcttcagtccacctccataacaggaagatgctcattgcacttccagcctggggtcctggcgtgcagtaagtccccagtaaatggacaaagtgcttcataaaaaacaaagaatgcgttcagacgtcaggactggcaggaggatgcccacacccgccctccccccacccccagccactgacccagggtcctttaccttcccatacaggttggggtgggtacccacttccttcagagccagagggggttcagtgcaggaagaaggggcctcagggacagaatgccaggcaacgcaccagggatggagctgggaccttggccacttgacaggtttgcttcatttgctcaacaaagttatcaagcattcatcaagcacctgccccctggcaggctctgtaccaggcacagaagtatcaggtgagaaggcacacagacccaggcagtgacacctcctgctggccccaggcgggtggggccgggttctgcccctcctggcttgcgctagttggacacatcctggggccacttgagccacaaggccccgctactgcccaggtaagatgacctgtgactcagcagtcaaaggctcttgaaggctggaggtcagggagtgggctggcggcagaggtgggcatctcccactcttgtgctctcttccctgcaaaggccgctgcttgcagagactctggagctgacaaggcttggttcacatccaggctttctacataattcccagggcccctgagggagtcaatttctaccctctcagccccagatgccgctaggagaatacaggaaacactttaaatgatttactatatgatttctctttctctttcataaagaaagctcctctgctacaaactaaccctgtgaggttggtattggtacccagctatagcaaaggaaaggctcagagaagttaagtgacttgcacaagatcacacagtatatatcaggcccatcaaactccaaagcctatattccttctagagcacatactagctcagggcagattgattgttccttcttgataatgggctcatctgagaccaaaagaatcctcagttcgcagaaagctgtcagtgatgaagggcccttctggggtcctgacccccaccatcagaagcctaaggtcttggttgataaccctggcactgttgcagactggatgacctcaggccaggtcaaggtccaaagctcataccaagccccaggctcccgctcctgaaatgcaggggaggagttaagcattggacacagcattcctggcctttctctgcttctcacctccacctgctccatcacacagactgacccccaggcttccctctccagggaatccatgagactagcccacacaaacatggcaagaagctgctctgctgaaaggtgctgcaacttctcagaagcatagtgcctgcccggggctgaggctgcaggagctcagctgagatgccttcctgatgtatcttgagtttcccctgaggatttcctgcaggtcctcgaagcagaccttccagctgaggaagctctgcatctgggaacacaagagaccctgcgtctgtctgggcagagagacgcagtgggctgaagtcttccctagcctgttctgggcttatgtcttggtcgctggcactgctggattctcctggccacaaaggaggtgagaggctcagctgaaattgtaagggactcccagacctgagatgctccaattgtaattaaattccctgatcaagccatcagataaactggattgccttcacaagagcacagaatcagccagctataatgccagacccacagctcctcttccccagcctgcaggatgatccagcagggggaaggtactgtcattaaaaaggactttggggagagaacaaggaagaatcagatgtggaagagaactgctaggacgccccacagccaagcctgaggtcagacggcaagtgcccgggaaggaattcctggcaagcctgcgtcctcatgtttcaccaagacgtccaatgtgcctcagagaaggacaacatcagtggctaaacatctcttttccaggtgggatctggcagctggaaaacctgtgctgtagccagagtggtaccctgggttcttgtttgcatccggagcagttttagttgcataaaaaggaaggtgtgtgtgtatgtgtgcgtgcgtgtatgagggtgtatttccccctcagtataacattattgctggttaacaggataaattgggaaaatgcaactacaaagcgaaaccacacagccctgtctcccccaacactttcagccttctagtgacttctgtttgtcctcgggctttagaacactctctgctgtctccctcagcacagttaagattttaaagtgagcattttcctctcactctgagcccttcctctgcccaaaggctgctccctggttcacagtcttaaggtcgtttccatcttctgctattctggatacgcctaccacaggtgcctgcatgtgtgggaagcttttcccacgttctgaactatcccctttggatgaaggctctccatctgaagatcctctttgcaggttgattcttggagcctgtgagagctggagaccatgcctcccaacctgggagccctccacgttctttgtccccaaaatggccagagggcatacctgcgagaatttcccttctgctcaaggcccacagggatgcgggtgtcaccccagtggccctgaaaaggggactgaggctcctgaggagacaggttctcgtttgcttcatgtatgaaaaagcagcccatcagctggagatttctctttggggttcacggtcagacgcatgggggtcttgtctctgtcactggctagctgtgtgactttgggcaagttacttcccctctctgagcctgtattctcatctggagagtggagatgataatggcacctacttttctcgagtggctgtacacatgaagtgcaatgatgcaggtaaggccttcagcccagagttggctacagcactgtaagtggttaacacattggaaccattgttgttactcagccgctaagtcgtctctgactctttgtgaccccatgaactgttggttggaaccacagatggctactttagctgcatagccctttcagtccaaaaggtgtcctctgacttctccgggtgttcatttctccagggctaaatgggactgaggatgatttctgcctcccagagttgccagggagcaaatgagcccactgggataagaaggaactccttgtcaactgcagagcgcatggtggtcatttactttgcttgttgttggaatcttctggtgggaactcactacctatggatggggccccaggggcagatctggctaatacagcctcctccaggaagacaaagcctgtctctagctcttcacaagctggctccaacttccacagaaaccccccatcccaacccccgggatctgggttcacacagcgctgaggtccagccctggatgcatcactcccatctgtatgtccacgcccactggcccttctgtccctcaggcttctctctgtaaagtggtggctccccttctgccttcttgttagacagagcaggtgagctcacagtgcaccccgtgggtgctcattcttcatacatttccttttccccgaagatccacaggccagagggccccttctcccagctgcctgggtacatctagaatcaccttcctggtgctctgcccgccatgcctgatgtgaccagagtgggggccaggctggtctgtgaaggtcagaggtgtggatgggctcggggtccacagagagggggagagcaaatgagacccagacatgccagcttgtccaggccctcccccaggtgaaggtgtagcctgggatgagagagctcttaggggggcggcaggaggcgggatacacagccctgccctgtaccagagctctcacagtggagagctgtggagtgtgtgagtgtgtgtgtgtgtgtgtgtgtgtgtgtgtgtgagtgtatgtgcacccagttcagtcgctcagtcgtgagcgctctgactctttgtgatcccatggactgcagcacgccaggccgtcctgtccatcaccaattcccggagttcactcaaactcatgtccattgagtcggtgatgccatccaaccatcttattctctgtcgtccccttctcctcccgccttcaatctttcaagcatcagggttttttccagtgagtcacccacctgcaattataaaaccagatgcagtcaggaatgtttcaggagtgctggggggctgtggcagaggtgtgggcagttgcccctggggttagggtgtggaggcagaggtgggcttctggaggagggcatacctatctatgggagccggtgtcttccagggccctgagaagcccctcccgacactccccttggtggtggctgcacagctcccgcccagaagccagaaactgaccggaagggcttaaggcagtctagactccctcccaaggagcccgacctggcctgctcctacctcctgaccctacccccatcaccttaccagagcctgggggccctgggagtgtggtcagggagctctccccacacccaatggccagggaccacgggggagaccggaggcaagacccaagaaggcaggcatgggtgaaagtcaggaagcccaggacccaggctggtcttcgtgggcgcctcctgcagacctggcagcctctatgcctgaaacctcacagcaccttccaagggcggtgttgtcatgacccccatcttacagaggaagaaactgaggcccgcagaagtgacagaaccattctcccaagccagcgctgagccttgagccccatctgtgacagagtgtggcacacagagcccctcaccatgacgctgctgtgggccagcttgcgagtcagtgtgcccacccctccccccgaccctgtaaggcaggcggcttcagctcccactaaacaaacaggaacaagaccccccaggggcactgccctctcggagtggagctggctgtggcaagtgaggactcagggcttttattgccatttcagacacacaggaaggtcaaagcagacagaggggatggccgcagaggggcctggggtctccccactgggatgcctcagctttgaccccacccataaggacagccatgtgcccttctcaaccaggagggcaggtgtgggaggcctccaggacatgagatgggtcagcagacaccacctggcctgatgagcaggtccacccagggtgacctcggcctggcagtcacagcccagtgccaagaggaaggcctgggctcgctggcatttccagaactgccaggcaccagggtgggggcctagggttggtacccatcacagctctcagctaatggctgagatgtcaatccaccctccaaagtcggtccaaaataacttaattagcttgaaagagctgctggcagcctgccaggatggggtgggggaagggtagcaggacgagggccccccaacactgcagggaagaaccttgacaggaagacaagagcacccccattctgtggactgtaccctttcctcatcacagggactcgacccaccatggctctgccaggtccagccaactgagcccactggacagatgaggaaactgaggctcagagggggccaggatgcgctctgctgtattcatggcagatgggcactttgaaagtggggtgatgctacttgggggcaggaaaagttcagccctagaaaagctggtggggtctctagggagagagattaaggtgccagcaacgtaccatcaagccagagggatcccaggttgacatcggaagggacttgaggctgcaggaaaggacctgagcctaatctggaagaaaagagtgtgtggcatgaggcagtatccaccttgagagtcccagcgctgggggtccttgcccctctggcagagggttttagccagagccaagtctctgatagggtggcacctaggatcccctgctccctgcagcccccaggacactgggagcccaggcatggcggtgatcgggtgcgatcagggtgagacagacacacagccactgccctccagaccctgatgctgccctgtcagtgccaggctgggcactgccccaggatcacaggcaagggatggctgtgtgtgtggcagcccagagaggaacatgggacgcccagtgagctggagctctgccccaggtgtctgctccaaggctgagctcactactggtcccactggacacttgctcctcccacctcagagaatacactccgtcaaccacccaggttcccaagtcagacactggctgtctccctcctgctcaccccacccccagtcctgcccaagtcacctcccgaacttttgtaatctatctatcctgcaccctgtcccccatcccacccaatccagaccaccactgtccctctggatcgctgccaagtccttgtcacccatttctctggtctgcacactattctctctgtctctctctcacatgcatgtgccccatgaattatcaagggaatctttccaaaactcaagttcaaccaggtcagcctcattgccctccccaacctggccttggagactggggggattttcccactcacctcactgaggttggaacagagcaactgaaaccctgggctccagatcagccaggtctgggtctgcatcctgggtgggccgtttggtgactgtgtgatcttggatgagtcacaccaccttcctgagctctttcctcacctaggaagcaaggctgccacgaccttcatcaagaagaccccatggggcaccagggtggggccatgctgagcgcccggctcagagcagccacaccacgtggcaccaacgggcaccggccagctcccggctgcctctcaacacccgcctcacgtgctgcaggctgtgacctgacccggcagctggtcctccctctggctccaagagccccgtaacaccttgctctccacctatcggttctctggcctgtctctacctgtgagcaggagtagagcctgggacaggctcgatttacatttgatgaatgaatgaatgcagtacgagtgtctacagagggacacggccacgtagagaggcgcacaacacacacagccacctgcggctcagacgggctgagggccagagggggcccctaggttggtccattattacacacccctcggtgcagcccagctcagcttgagcctaagaagaaagctcaggacctgttttctgagggtccacgagggtgtgtgccctgcctccatcacgaggcatctgagcctaccacactcgggactacaaggagcagcccagggggccacagcacccccctgggcagggctgcctaaagtgggggtgcggggtggagtggtggctgccagctggcgagcgcctgggcctggcagtgccgccgatcgcccactcgcaccagctgttagtttccatggcctgcccaccagctagccaggatgctgggcccgggctgccctggggtgtcctgccaggaagaggcagcctctaggagggtggcctgggcagaggggagggcagaggaggggcaggggaggatgaggatgccaggctggaggaggccagggccaccctccgctcacagtgtggcccggaacaggctgccgcacttccagcgcctcaggcgcctcttctgggcagtccatgaggggccggaggtggggatggtgcccagggctcctccctccgctcaaaacacccagcaacagggattctggaccctcgggaggggaggtgctccgaggtctgcgaccacaagagggcgcccgagcctcaccttgcagggagccaaggcctgaggcccgcggtggagctgtgcctgggagagggcctgggagctgggactgaatccctgggcgtggcatgcagctacctgcgtccattctcaggcaagaccccatccacactttagctcttttttcaactgatggcaacactacctgcttcagtatacgtctgcagagtaagcgcaggaacacgctgctgctaagtcgcttcagtcgtgtccgattctgtgcaaccccatagacgacagcccaccaggctcccccgtccctgggattctccaggcaagaatactggagtgggttgccatttccttctccaatgaatgaaagtgaaaagtgaaagtgaagttgctcagtcgtgtctgactcctagcgaccccatggactgcagcctaccaggctcctccgtccatgggattttccaggcaagagtactggagtggggtgccatttccttctccaggaacacactaattgaatgataacggtgatgtagtattttaccgatgaagagaatggactcagagaggtttagtgatttgcctaagtcacacagcagtaggcatggagcaagttattccctctggtgctgggtgctggcagagctttggaaagagtcctggcaccaactcacagggggttagcagcactcaagtcctcagggtagggaccaagcctgattctggctcccccaggtcaccctgtgccataaagaccagacccttttctgggcaattacattaatgaaaagaggtcccagctgtgagccctttacacacccatgaggcatcctcgtcctctgactcacagatgaaggaggaaggcatgagagaagttaagaacttgccagaggccacaaagcttagttccagtactttggccccagaatccaccctcccctcaccatgctatgtcctggggaaactgtttttcccaaaggagcttctggccacctccgtccctctcctgttcacccaacagctttcccacctattcagttggggcagaggtgaacaccaggcccggccccatggaccgaccaccacccaaggggagacagacaaggtgcacatgactcattcagggccggagggcccctaaccaatcaggggtgtcagggtcttctgtggggaggcaaccactgagctgagttgcaaggaaaaaatgtagcacaatggcccttgctggcctcccattctgggcccagggggagctcgtgagttgggagaaactggccctgtgtgggtaggaggagtgggcaccccaagggcgagtccaggctggttcccagcaccctccagcacctggtcatcacaaagtcatggtgggctcatcaaggaatcaccactgggttgtgattggttatgggtgttcatggagccaagccctccaccagccttcccgcctttctctcaggatgggtaccccctagggcttcctcgattctatggggaccagagttggcggggtcaccaccctctgggtacaccgggcacagaccattgggccaccaacgcagcacctggagcccagagctcagagtctgagcagagcctggctggagggattgggggcaccagccagggtcccagcctgctgccttttgcatcaccagcctggagcccagcccagggccggcacctgtgcctcaaggcaccttgaggacctaactgcgcccctctgagaccctcttcccctaatggggcagtgaaagcacagccagccccagtgctccctgaccctcctggtctctcagggcctcctgtgtggttctagaagcaggactcaggctgtggcagccacctctctccaccagtggccaccgacactgaggtgcagagggagcctgggggctgtgaaggaggctgctccccctcatcgtgccagcagtggtgagaatcagacttccccgttcaaggacccccagctgatgttctttgtacccctgtgcccagccaccccctgcccctcagttctggggtccgtcagcaccaacagccctctcctcctctgcactctcccagccatccccaccccggacattgcctgcccccagaaccgccccctgatatttcccccctcccacccaggactggcttctctgtccaccatcctccaccctccctgttgggctggcttcactctcctgaccccgctctctgacctcatctcacccccctttcctcctcctggactccctccttatccagcctatatcccaagggacctttctgcacccagagtctcgagcacaccgaccctcaaaaatctcccaccccattctgcaaatgcccagcctggggcagacccacagtgctcctcctagaggatcccatctgtccccaggccccagggtccccctcccttgtctctccccacttcttccttccatcaagaaacacactcacctcttgataatgatctttcaagctgctctcttagccctgcacatggctccaactgggccccattccttctccccagcctggtggagctcttcaagcgttacttgtgtgcccatctctgcctcctcagccccctgccctctgcaccgcagtccaccaaaactcttctcatccgtcactcctgctacatcccgagagagttgggttcccatcccaggctggggccagagagctgtgccctgctctccccctcttccctgccccctgctcgtctccatggccccacgccctagtgaaggtcccctggctgctccttactcccccagtaggtccttctgccatcctgtcccacagacgacggagctctcttctagccccacatgatcatcccataccactgccccctcttacccggtaccaatgttcccaaactcgccaaggcctgtctccacgcccagggatccaactgcgtcttcagtgtgggtcaactccatccaagtaacttaatcgtgacacagtaacttcatgaaggaagtactattattatccccaatttgcagatgggggcaccaaggcacagagagagttgcccagggtaaacagctgatcagcctctgaaccaaggtctccttcctggagatccctcaagagcctcagattcaccataaacagaacaagctcacgggctctgcactgaatgtcttcttcctggccaagctggcctttggactggacagtgacaagcgtctggaccgtgggcaattttactttctgtgggaagtacttaacccagagctcaacagcagtaagtggccagtacaggccagctgctgttgtcaccatggccctccaaacctcagctgcttctagaagatggggctattgggggaatgtctgagctcagggcctggccacacgggggagactatagccctggccactccgcacaagagcctttttgcagtaagtcaaagcagcatcaatttataatgctgcaagtttggcacaaatgcactatttttcttaagccaaaataaagctccaataagctgtaaaagccctggagttgggaggattctctgcggggtcatttagggtgagttagaacctgcagctgtgaactcctcagccacacatggcaacctgggtgggtacaccccagaatgctaatgaaggcagctgctcagggtcggggagccagctttgctctggcttcaggccccagggagagggaaagccatgtggggtgagacaggacaggacctcagccaccctgggctgcgtgatctgggccaagcccgggccccactccaagctgcagcttcttccgatggggttccgaagcatgactcagaagagggaagttcagggcctggggtggggacttcgaatgatgtgtgcaggcattttcattccttgggcagagatctcaggatttgtaatagtgttgtaggaaaaatgggattaaacatgccaatatttgcttatgtacacaaccgtttccataaagcaggattgtgccccatctcaatggaagcaaccccaaagtccttcttgtttggggcaggtgagcatatgggaggctggatttgatcccaaactctgccctttgccaatcatggtctccccaagggacggttccccttgcccgttccacaggtgaggagactaaggcctgactctaaaatgcagcatcttaacttgtgtatatgcatgtgacccagctcccagtctctctgacctctggcttggtgaggtcacctctgcccgaggccctgcaccctcccccaattccctggtgcctggcaaagaacccagatcttgaaactccagagctcagctctgcacatacaagttcacgatcagaaacaagtaggtaccctctctctgggcctccgtttcctcctctgagccttggtaaaatgagggtgatgatggtagctaccccaaacagttaagctaattcatgcaaaacacccttgtggtgcctggcacaggataagtgctcaaccagcattcaatccgttcaggagataggatctatgacttctactctgaagataagtaaacagagaattggagaggtttggccacttgtccaaggtcacagagctcaggagctgtgatggcagggggagggtgtgaggggggcacgagctgaggctcaaaccaggtctccttgtccccatcagggtccagatggaaggggagtcaccgagccaaagcccccagggcagggacagggagagaagggaaggaggagagaaacaggaaggctaccaggacagagacgggaccgggagcaagctactgcctggggcagagggcccaagcccgcaggggtcacggggcacggttccccgggctgacagtgggcactctcaccttcaccctgttctctggtggctggtgaccttgacaactcaacctgcatcactcacatcctagtaaggccctgaaggcagacgttttgggggtggctcatctacatgacagcctcccacaccttgagccagagccagggtcctgccccctcccctggagttcaggagcaccctgcccacccaggggctcccattctgggctgcaggggcaggaggtgagccggagccctgagaaaccaacagcctacctacctgaggtgacctccaaccaacctcaagacctagggcacctagagggtggggggagcctccacctacagcagccagcctccatgtgcccacccgcaggcctcgcccatctctgctgacagctgggaattcctgccgtgtgacccagtcagcctttcagggctgggatcctggcccagccacccagacacggttatagctcaggctgtgagctgcctatgaggccagggcaagtgattcccatctctgggacttggcttctccaggtcagaggagggatgagctgcgagctgaaacaactcttcccacccagaggatctcgggatctggaatcccagaagccaagtgttggagagaacttcgggctgcgatttcctaacactggcctgcagcctgacaaagtcagggtccccggggagtcctgtgaacatgtacacgcgggggctcccttccacccccagcagatcagcagatgcggagccgggtgttctgcagatttagctagtgccctgggtccatgccttctgctgactctcaggggtgggggcaggggaaggaaggggagggtggggctgagggttcttcccgagacaaggtgcccagggatccctgagcctcccaaaatctttactgcttcatcccttgagtgtcctcagaccccctcccgcccgccacccagggctggaatccagcctttgctcccatcagcaactcctccacagaattctccaccagcttctccccatcctggtcctcttcacccaggagaggccacagctactggcccttccagcttcccctcccactcaaatcaggggcctgctttttgttttcttcctctcaagcctgcataaagaacactggatttagatgaacagctctgtgcacaggccctgtctgggccccatgtaactgccaccctgttgagctctaacacatttcctccaccccaaagagcccccagtcaagccccctgctcactgcacctccccggcccccctcagcagacctctagccccacagattagaagggagaagcctctttctaagcagctcttctgtgctcatcaggttggactgaaacccctgaggacagcaactgggctgtcctgctggctggcagtgcctggcacagagcagacattcgggaagggctgtgagaggaaggacaaggtggctgcaggctgcacccctgctccagctgctgccgtgatgagtctccttggctcatcatcccagcttccttcaatgtctaccacactctcagcccccagccccctgcaggacgcctggcacatggacacgcaggtgcaacacccccacctgccccggccaggcctctgtcaatgctcagacacctctttccccacagggctcctgccccatccccaagccttggctcccagaatcctggaatcacaggcacaccgaattcctggatctgcactctccccagtgcctccagcccctacccactctggcctcacttgtcctggcaggctgtcttctgtccctgtcccagcaccgtctcagcccccacagcaactcagagcctccgcactaagctattagcaggaagtcagctctccctcatgcccacaggctcccgcatgtgacctgcgacgagcaccctcccctctccaagcctcagctcctccgtctgtaagacagccccatcaggctatgtggattcagtggactcttctggctctgatgtttcctgcagatcactgcccacggttagtgtaaataaacatttattagataaataactagccccaaagaatgagtcatcattgatggtggaacggtagacatcagctgcaggccacttagaggcagaattcaagagtggtggtgaaagctggattcagactgcctgggttggaaaccctggttcacgacttcctcatctgtaagatggagatcacagtagggcagggtgaggatgaagtgcgatagtgtacagaagcagccagaagagcacctggcacttaaccagcgctcaggagaacttagctcccactggtacccccagcgccactgtccctcagcaaggctcgggagtccacatcagcgacctgcgggtggagccaagcgtagcagcagtgcctgactagtgccaccagagggcaccatgacgcagccaaagccgcccagctgaaccgagggctccctgattcatcctgagtggcagtgccagccagaagcctcccagctgggaggacgagggtggggcctggatgcccgaggagttctttctgcaggagatgcccgcaccaccttggcttgatattctgcccattcctagcacagtctgtgaccaacagcaacccaaagtgtccctaatccttccctccagagccatcagacccatttaacagatgaggaaacaggcctgagagaggccagctccaggtcatgaggtgaactctggccttcctgctcagactgacctcccagtacaccccactaaacactatgggtgtggcgcccacccccacaaccaaagctgggagccagcacctgtgcccacctgacactccttgggcagaggagagacaccagggaaaaaagcacatctaatggtggggagacctcaaggacggagggcccggggaaagtgctggatgtgagaggaagagacaaagaaacacgaggcgaaacagggtggggtgggcacggaagacaggagatgcaggagagacattcgagaaagtgaatgggtggaaagagacagacaggggaagaggcacagagacagagaatcccgagggagaaggcaaagagagaagcagaggcagaaggacggagacagaggcagagggagcgattgaggaaaagagagatggggatggggtcatggtgacagagagagacgggaggcagacccagggacaaagacctgtgggcaggggaccctggagggccaccgaagcggcttcactctggtctggagcccccatgccctcctcccaggcactcagccagagctctcgcccttgcatttctgtcacaccccctaccccagcagggcttgccagacagacaccccctcttgggggtggtggttgagccgggttccctagggcatctaaggcagacaggtagggtccctggggccgtgttgctaggagatccagcccagggccccagcctatctcctgagcctctcctagggcaaggctcaacactcacctaggggctcacctgagacctggattccccctagctttcaccccgtctggccctggacagcctctgccctgcatcctcttggcagagggaaggcacacctggtgacccagccggttgccaggcctccctggctcctgccccaggccccggggcctgctgtgttccttagaagcactagattcccgggcttgggtgcaggtggcagggagattgttcaaatctcagcctgccttttaccagctgtgtgcccctgggcaagtcactctccccctctgagtcttatctttaaacaaaaataataacagtatccattccatagggtcctctagaggaggaagagccataatgagggcacagcaactgggatgggagactggttttaagctccatctctgagccacctgggctgcagctgggagcatctccccgcagtccctgtctcccctttgcacctccttgagcaggctagagtctgattcacagcagcctcaggggaaggggctgcccagagccctcccagggaactcagataccaggagacatgaacactaggggcccaggcaaaaccacacccacatggttgttcgggcctgtgtgctgctttggggccttagatgaaagcaacttcagggcttcccaggtggcgctggtggtaaagaacctgcctgccaatgcaggagacataagagacatgagtttgatccctgggttgggaagatcccctggaggagggcatggcaacccactcaagtattcttgcctggagaataccatggacagagaagcctggcaggctacggtccatagggtcacaaagagtcggacatgactgaagcaccttagcagnnnnnnnnnnnnnnnnnnnnnnnnnnnnnnnnnnnnnnnnnnnnnnnnnncagctttctcacttgcactgctgctgctgctcctgctaagtcgcttcagtcgtgtccgactctgtgcgaccccatagaccacagcccaccaggctcccccgtccctgggattctccaggcaagaacactggcgtaggttgccatttccttctccaatgcatgaaactgaaagtgaagtcgctcagttgtgtccgactcttagcgaccccatggactgcagcctaccaggctcctccatccatgggattttctaggcaaaagtactggattgggttgctattgccttctcctcacctgcactgcaggggagttgaaaaggatgatctctgtctgtctagcttccaaggaggcctccgactgttacctccggtattcacacccctgtgtaatcactgaagagactgaatcagtgtaacagatggagcggcgtgaacgtgagagtagggctcccgaagcacaggacagggaggctacgctgctcctctgatcacaggctctggggaccccagtcgccatgtggtaaggatactcaagcagcccagtggagaggaacggaggcttcccaccaacaaacagtaccaaccagccaggtgagggggttagtcaccttagaagcagatcctttatccccaggcaaatctgcagatgaccccagcccctgaccccagccccagccaagatcttggctacatgagagaccctgagccagaaccactcagctaagccaatcccaagactcctgatccctagaagctctgtgagataataaatgctgattgttcaaagccacaaagttttaaggttactggctacacaaaataaagtaatgaatatatttccaccttctgctgcctacccccagagttctggtctgaatcattggtctttcagaaaagccctaggttggtgtcaccaatgtcaaactcaactaagttcagggaggagctcatcatatccccccccatctacttccacaattagccattgccaacggacgtcctctagaatcaaagacagatacgtggtgtgcattattgttcagtcgctaagtcatgttcaactctgcagctccataaactgcagcgtgccacggttccctgtccttcaccatctcccagagcttgttcaaactcatgtgcattgagtcagtaatgccatccaaccatctcatcctctgtcacccccttctcctcctgccctcaatctttcccagcattaaggtattttctaatgaatcagctcttcgcttcaggtggccaaaggattggagcttcagcttcagcatcagtccttccaataaatattcagggttgattttctttaggattgactggtttgatctccttgcagtccaagggactctcaagagtcttctccagcaccacagttcgaaagcatcaattctttgctgttcagccctctctgtggtccaattatcacaaccatacatgactactggaaaaatcatagctttgactagacagacctttgtggtgtgcattattgccttccttatcccagcattcagccactgacaaacttggcctcttttatctcctgcccatctctagaatcctccctctctttaccaagcctaggtgccctgccccagctcaggccacaccctctcttgccagttcagcggctcctctctagtctccctgcctccatccttgctgctcttaccacccatccatcctccacactggccgctagagggagggacttcctaaaacatagatctgatcatgatgctcacctgctcattaatcttccatggctcccctgttgcctaaggcccgaactccttggcctggctttgaaggccttttttcatctgcccctaccccttacctctccatcctcatctctagtttttctttgtctcagtgttccattgatactgagccacctgcaattcttggaacacaagagtttcatacttccacacctttgctcacacagttctctccacctggattcccctccccttctttacctggaaaattcctactaatctgtcaagccctagccgtctgattctccgtgaggagctggtctctcactgcatcttattggactacaacaaactgtttacatgtctattcacccacaaagtgacaacctccaaagcaggatgtctttttcatctctatattcctagtaccttgctcagtcccagcatacagaattccataaagttcttaaaatggaagacctttagattgaactttaaggtcaactcatttaaaaatcattttggatgggaacacctctaaaaggtattacagactctcctacctttttaaactagtttatgggacatgattgaaccttgctcgagtgtatggtttatgtcagtacaaaccccgggtttttcagaaggagccttggaggtcatccaatagaggaaggacctcaggtctggaaagatcacgtgacttgcccaaggactttgcatgacgaacgttaatgaacatctgagctgcaagacggtgatctctttgctttgatgaaggatgtcaagcccttgccttgccacggcactaaatggcccctttagtcaatgtctttaaggtttctgtatgttttagaatcatcccatttcagcactaggccagtgtacctggcccccactttacccctctagtttgttacttctggtccactggaggcaggaggatcaggtaaccaaacttgatggaatcacacggaaaggaagagttacagccctggcctgagacctgggagcactgctcctcgggggagtgtggcgggacgatgggactttgtggccctcctgcctctgctgtgccccagatatgacagttgtcgtgaggagagactgaaggcttgggctggttctggcggagggaagtgtcagcataaccaagagatcctgcaggcaattcactcccaggtagatgactccacagggaggacaaagaggcggatcctggaccctgggctccataagctcccttcccacactccctcatcagagacaaagtgcatagtgcaagaggcaaaaggaagcagggcctctggggtggggtggggagagggggnnnnnnnnnnnnnnnnnnnnnnnnnnnnnnnnnnnnnnnnnnnnnnnnnnactggataggtgggaatagctctgtttatcttatccagcgagcaaacgaatgagggtggaacaggaagcaatgaactaagagatgaggattctagtccagcttccactactaactggatgcatgtcaaggggcaactcaactagtcaatctaggtgtccgtttcagaatctgtgaagtggggatgtgtgtgaaagttttagtcgtttagtcatgtccgactctatgccactccatggactgcagcctgccagactcctccgtctatggaattctccaggcaagaatactagaggcggtagccattcccttctccagggatcttcccgacccatggatcatacccacatctcccacattgcaggcagattctttaagatctgagccactagggaagccctgaaatggggataattcctacatcatggggttatagtgggattaacaaaaataatgtaaaaaagaacttagttctaaagtgctgctcaagggaacatggccttcattcacgcattgcacaaacacttactgattacctactatatgccagctgttccaggaactggggctgtggccatgaacatgacaaagcccaggtcccatggagctgactttctggggcgggagacacataaatgaataataatgtactaatcagtatctcaataaaggacagaaacggtatggacctagtagaagcagaagatattaagaagcggtggcaagaatacacagaagaactgtacaaaaaagatcttcatgacccagataatcacgatggtgtgatcactcacctagagccagacatcctggaatgtgaagtcaagtgggccttagaaagcatcatgacgaacaaagctagtggaggtgatggaattccagttgagttatttcaaatcctgaaagatgatgctgtgaaagtgctgcactcagtatgccagaaaatttggaaaactcagcagtggccacaggactggaaaaggtcagttttcattccaatcccaaagaaaggcaatgccaaagaatgctcaaactaccgcacaattgcactcatctcacatgctagtaaagtaatgctcaaaattctccaagccaggcttcagcaatacgtgaaccgtgaacttcctgatgttcaagctggttttagaagaggcagaggaaccagagatcaaattgccaacatctgctggatcatggaaaaagcaagagagttccagaaaaacatctatttctgctttattgactatgccaaagcctttgactatgtggatcacaaaaaactgtggaaaattctgaaagagatgggaataccagaccacctgatctgcctcgtgagaaacctgtatgcaggtcaggaagcaacagttagaactggacatggaacaatagactggttccaaataggaaaaggattacgtcaaggctgtatattatcaccctgcttatttaacttctatgcagagtacatcatgagaaacgttggactggaagaaacacaagctggactcaagattgccgggagaaatatcaataacctcagatatgcagatgacaccacccttatggcagaaagtgaagaggaactaaaaagcctcttgatgaaagtgaaagaggagagtgaaaaagttggcttaaagctcaacattcagaaaacgaagatcatggcatccggtcccaccacttcatgggaaatagatggggaaacagtggaaacagtgtcagactttattttggggggctccaaagtcactgcagatggtgactgtagccatgaaattaaaagatgcttactccttggaaggaaagttatgaccaacctagatagcacattcaaaaacagagacattactttgccaacaaaggtctgtctagtcaaggctatggtttgtcctgtggtcatgtatggatgtgagagttggactgtgaagaaggctgagcaccgaagaattgatgcttttgaagtgtggtgttggagaagactcttgagagtcccttggactgcaaggagatccaaccagtccattgtgaaggagatcagccctgggatttctttggagggaatgatgctgaagctgaaactccagtactttggccacctcatgtgaagagttgactcagtggaaaagactctgatgctgggagggatagggggcaggaggagaaggggacgacagaggatgagatggctggatggaatcactgactcgatggacgtgagtctgggtgaactccgggcgttggtgatggacagggaggcctggcgtgctgcaattcatggggttgcaaagagtcagacacgactgagcgactgaactgaactgaagcagtatctcagtcagaatgggcacaactatgttgccatcaatgattcttaaagccactaagagtcattttcactcacactgtatgttcttggagaaaatgcctgtaaaccatttcaagctgcccccatctagggacccaggctgaaggaggctccatcccgaacttccacaaaagggcacatggcaagtagcaccaaagtccaaaagccccgaccctagccctgaaagtacacagatcacgactatcccatttcacttcccgccagctagtaacgtggttatgttcatcttctgcaagaggtgggggaatgcagccctgctgtgtacccagaagatgtatgtaggtgcagtgtatttggtagacagcactaatgcccattatggatagagtcttggctaagtaccacgaaaacaaatagtgtaaagagatgtgaggttggggatgagggagtctgggaaaggcctcccgaggaggtcacgttcaaacaaatatgtaaacaaaatctggagcaatcccagaggaagagcacaggaacgcaagggaggagtgagtgtcctaggacaggtggagagcaaggagcccagtgggctggggcaaggagccaggggcagtgttgtaaagagagaggcattcagggaaggaagcagaccacacggccactaagtcagccagggcttggtctttcctcggtgagatgggatgttgttacagggggctgcagatgagcagaacctttagtagataaaagacaaacagtccctggtgccagaatgcctgcggccaaagcccagctccatcccccactagcacaagaccatgggcaagttacttgatctctctgaagctcagcttcctctccataatcagataagatcagatcagatcagtcgctcagtcctgtccaactctttgtgaccccatgaatcgcagcacgccaggcctccctgtccatcaccaactcccggagttcactcagactcacgtccatcgagtcagtgatgccatccagccatctcatcctctgtcattctcttctcctcctgcccccaatccctcccagcatcagagtcttttccactgagtcaactcttcgcatgaggtggccaaagtactggagtttcagtttcagcatcattccttccaaagaaatcccagggctgatctcctttagagatcagaatggaccttagaatggactggttggatctccttgcagtccaagggactctcaagagtcttctccaacaccacagttcaaaagcataatagttgaggttaatacaaagacctacctcccagggttattgtgatggtaaaatgcttaaaacagggccagtgacaggaatggagactcagacaaagagagcagacttatggacacgggcggggtgcggcagggagggtgggacagaactgagagagtacattgaaatacatacattaccataggtaaaacgtgtcccagggacgggggagcctgatgcgctgccatctatggggtcgcacagagtgggacacgactgaagtgacttagcagcagcagcagcagtctttatcttggagaaggaagtggcaacccactccagtattcttgcctggagaatcctacggacagaggagtctggttggctgccttctatggggtcgcacagagtcggacacgactgaagtgatttagcagcatcagcataggtaaaatgactgtggctcagatcatgaactccttattgccaaattcacacttaaactgaagaaagtagggaaaaccactagaccatttgggtatgatctaaatcaaattccttactattatacagtagaagtgacaaatagattcaagggattagatctgatagagtgcctgaagaactatggacagaggtttgtgacattgcacaggaggtggtgatcaagaccatctccaagaaaaagaaatgcaaaaaggcaaaatggttgtctgagaagaccttacaaatagctgagaaaagaagagaagcgaaagcaaaggagaaaaggaaagatatacccatctcagtgcagagttccaaagaatagcaaggagaaataagaaagccttcctcagcgatcagtgcaaagaaatagaggaaaacaatagaatgggaaagactagagatctcttcaagaaaattagagataccaagggaacatttcatgcaaagatgggcacaataaaggacaggaatggtatggacctgacagaagcagaagatattaagaagaggtggcaagaatacacagaagaactacacaaaaaaagattttaatgacccagataaccatgatcatcgtgtgatcactcacttagagcgagacatgctagagtgcgaagtcaagtgggccttaggaagcatcactacaatcaaagctagtgaaggtgatggagttccagctgagctatttcaaatcctaaaagatgatgctgtgaaggtgttgcactcaacatgccaacatatttgaaaactcaccagtggccatcagttcagttcagttcagtcgctcagtcatgtctgactctttgcaaccccatgaatcacagcacgccaggcctccctgtccatcaccaactcccggagttcacccagactcacgtcctatagagtcagtgattccatccagccatctcatcctctgtcatcaaccttctcctcctgccccctatccctcccagcatcagagtctttccactgagtcaactcttcacatgaggtggccaaagtactggagtttcagcttcagcatcattccctccaaagaaatcccagggctgatctccttcagaatggactggttggatctccttgcagtccaagggactctcaagagtcttctccaacaccacacttcaaaagcatcaattcttcggtgctcagccttcttcacagtccaactctcacatccatacatgaccacaggacaaaccatagccttgactagacagacctttgttggcaaagtaatgtctctgcttttgaatatgccatctaggttggtcataactttccttccaaggagtaagcatcttttaatttcatggctacagtcaccatctgcagtgactttggagccccccaaaataaagtctgacactgtttccactgtttccccatctatttcccatgaagtggtgggaccggatgccatgatcttcgttttctgaatgttgagctttaagccaactttttcactctcctctttcactttcatcaagaggctttttagttcctcttcactttctgccataagggtggtgtcatctgcatatctgaggttattgatatttctcccggcaatcttgattccagcttgtgcttcttccagtccaacgtttctcatgatgtactctgcatagaagttaaataagcagggtgataatatacagccttgacgtaatccttttcctatttggaaccagtctattgttccatgtccagttctaactgttgctttctgacctgcatacagatttctcaagaggcagatcaggtggtctggtattcccatctctttcagaattttccacagttttttgtgatccacacagtcaaaggctttggcatagtcaataaagcagaaatagatgtttttctggaactctcttgctttttccatgatccagcagatgttggcaatttgatctctggttcctctgcctcttctaaaaccagcttgaacatcaggaagttcacggttcacgtattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgatgaaagtgaaagtggagaatgaaaaagttggcttaaaactcaacattcagaacactaagatcatggcatacagtcccatcacttcatggcaaatagatgggtaaacaatggaaacaatgagagactattttcttgggctccaaaatcactgcagatgatgaccgcaaccatgaaattaaaagatgcttgctccttggaagaaaagctatgaccaacctagacagcatattaagaagcagagacattactttgctgacataggtccatctagtcaaagctatggtttttccagtagtcatgtatggatgtgagaggtggactataaagaaagctgagtgctagagaattgatgtttttgaactgtggtgttgaagaagattcttgagagtcccttggaccacaaggaaatccaaccagtcaatcctaaaggaaatcaatcctgaatatacagtggaaggacggatgctgaagctgaagctccaatactttgggcaccttatgtgaagaaccaacacattggaaaagaccctgatgctgggaaagattacaggcaggaggagaaggggatgacagaggatgagatggttggatggcatcactgactcgatgaatgtgagtttgagcaaactctgggagatagtgaaggacagggaagcctggtgtgctgcagtttatggggtcacaaagagtctgacacaactgaatgactgaactgatatctaaaatggaaagctgctgtataacacaaggagctctacctggtgctctgtgaccaggaaaatgggagggaggttcaagagggagggaacacatgtatgtgctgtgctgtgcgtagttgctcaatcatgtctgattttttgttaccccagggactgtatgtagcccagcaggcttctctgtccattaaattttccaagcaagaatactggagtgggctgccacttcctcctccaggggatcttcccaacccagggatccaactcccatctccaactctgcatttgcaggtggattctttagcacagcaccacttggaaaggtccaccaccacgatccaacaccaacagagattcatctcccgtctcttgaggcccagagcctgccagacatgagtctttccccacctctcctcagcctccacatctgctaggagggagcaaccctccccagctgtctaggcaatggagcctggagctccctggggagcacagtctctcctcctgccctgcgcagcaggtgggtgctcccacactgcaagacagatttctaattgcctgcactttctgccctctatcccagggcggggggctggggaagctctgggtccctcccctacagtcaccccccagcttcgttctggcagctaagctctctctcgggcaggagctggcacctcacccaggaggggagaacagctgcggagatggtgggagaattcctcccgctgctggatttgtaaaacaattgattaaagacaatgcaattaattattccttgatgaaatagtggaaattaccccaagaaaatgaagatttcagcagcagaacattaaatccctctaattatgtcatttctaaaaaaggggggagggggataaaaagggttgaaatggtgggccggagggaggaaaaaagtgtaaaaatagatggggtgactctggggctcctgcagggtgagcaggggcaatagaaggggtcaccgccctggcccggaccacattgtttgaggggaaagtctgaggtgacagagctctcggcgggggacagcaagcagccgtccagacactgggatacgtgccttgggtgcattagcaaattatcctcactctgaatcccggtgccttattcccgttgtacataggagagaatgaggctcggaagaggcacgtgacttgtccaaagatgagctactaattagtagagacaggccgtgaacttaggtttaactccagaaccggtgctttttcaaccccacctgctgcagtctatggcagtagccactgcagatgcccttggcagaagtggctgtgaccactagctccctgagggtctcagtggctcactgaagggctgggtgtggcagggagggtagctgccaggtgttgccatctctgccaataggaattgggcttgagctcccctgggaagctctagcccttcatcctctctgacacccctgggcatacttttggaagccagggaggggtggcaagtgggacctgccaggggcctagcctggcctggttctctctccctgggagacccagatgctccactagggtgctgatggcctaaattccaatctggccttgctggggttgccatgtggcctcgggcaagttcccttgccttcctggacctcagttttcctatctatattaggggatataagatcagtgcacgtatgggtccatttgagggtaccagatccagctcttcctcagctcagtttcaagaagccagaatcagctctagagtgggcaacaggaggaaacagacaaggggaagtttgagagccagcaaagaggaactctgggttctagcttctggggctaggctaacaggaatcaggaggaatccaggaggtctgtaagggggcagtgggtggaaggctatcccaggagggaagagtgatctgagtgggaggacagaagaagaggggcctggattgaagttagaccactaccccccattcctgcctcaggacaccaatcaaggggacccattgcctggaatggctgggcctggcagggcctaaagcagaggataattgattctcagcatcgctgaggttctttttagagcttgctttgtttccctcctcttggaccatatctgagcatatcccataatttttctggacactctcaggcactatcagtctcatttttatgagttaaaatttccaatctaatctagcatcaaaacttcaatttctcattcaatctaaagatttgctctttccctctctagctcaggcccaacccagcctaagaagcattcaaaagggatggaaggcctggtcctccaggatattggggctaccagatcctctctgtgcagtatttttggtgggactttggagtccccctcactgggatccttcagctagtaattccctgacatgtgcaatgatgctcctgcttctggggctcatcccactcagtctccaagaggtcacctggcctcaacaggcaggcccttccttcagcatgccttggtgtagccgctccgacccacagaagagcctgggcttgccagactatccccaccatcctagacagctccaagtcaccaccctcttctagactcttttcaagccagagtcaggccttggccactgtgccaacccaatgcttggggatacatgtcagcttttccaaatgtttcccctgaagctcccactgctcacacaatcaaggtgagggtagcagggcacagtcctcactgcccatctccccctgcctcacctcctcaccctcacttccctctgtgtagcctggaagtaagtagtgagggtcacagaaccaacttgggggcaccaaccttgcaaggcctgaagagatctacatccccatttaaaatgtgggagttctgggcactagttactctccaagcactccaagtacgccgtgtcccatttggacagcctattatgaaagcaagcctctgcttctccaactggttctgcctccttctttggccatacccctgtccttgtcacctaccccaagtcccaaccctctctctgtggcaggaccctacagcctcatgtccactactgagaagcacattcactccagccatcctgcagtgcctggatggagattgtggccccaagcaggctgcctgcaaagccaggcctcaaacctgggtgccaactcacaggccaatgcttcttccaccagctcaacccttggccatcctctctccaggagggatgagctgactgatggagcggctggggcagggaagagtcctttcccctctcgacaccagcagtggttcctacaaaagcaaagttgggagtttgaatcctggtgctcctactccccagctggctgattagaggcaagttgcctcatatttctgcaactcagttttcccccctgtaaaatggttatgataatactgaacccagagggttgccaggaagggtaagggagatgaggtcctagtcaggcattggcacaaagcaggttagtccccttaggacccctcccttgcagtcaggataccagggttccattccaaacccagagactaattttctggcagaaatgggtcttgaacttcccatttgtgtccaggaaagaaaggccacagagtggtgaggcagaggtgggagtctgaggggttaaggaggggaccctggaagagagactttagcattaggggtggtaggggcacagctcagatgggaagggctgttcctccccacccatctgctcccagacccctcccaccagagatggcattctagcccctcccacagctccagcacagatggcaggaaggaaatgccaaggcatggaggtagggaggggccaccaagcccccggaggctccagcccttgccaagtttcccagaggaggaggatgcaaaagccccctcccttgctatggcactgccctcccagagccacagcccactgatgccctggtgccttgtatcccgttgtcatggtaaccaggactagctgacgtgccgacaggcagaccaggagccgctgccacatgaatcacttgaacttgatgtgacagacccaggcgggtggcctgcacagaggcagagggatgtggtgccctgtgggcagggacggctcaggctgaatctctccaactgtgacaggtttaggggctccagaagctcatnnnnnnnnnnnnnnnnnnnnnnnnnnnnnnnnnnnnnnnnnnnnnnnnnntttcctgccctcactgagcttatgttctagtgggagaaacagacccaaaacaagtacccaaaccaacaaaatgccccaggaggtgatgaggctctgaagaacacagacaaggaactgggctgcagagcaactgggccaagggcttattttaggaaggatgatcagaatggattttctgagaagatgacatctcagctgagacctaagtgatgagcaagggctgaactctcaaatgaaaaagagagagttccaggccagggacagcaaaagaagaatctgagatgtggttgaagcacaggaggaggaccactgtgaagacagtagggcagacaggttaagtgtgaacggtgattttatcccaaatgcagtgagtggtggaaagtcaaggaactttgaataaagaagcaccatgatttgatttccaggtacatgctacaaaagctctagctgccgagtggagaacaggccttctgcagcaagcccaggaagaagcccgctgcagaagtccagagcacagaggagggtgctgtgaacccacaggcaataacagagaaggagagaaatagccatcttcaagaaaattctcggagacagaaactccaggacttgtttctggtccatataagagaggtaagggaaaggagagaaagaaagacaacatgtgggcctctggtttgagtttatgggttgtttgctgttgttcagtggctaagctgtatccgattctttgtgaccccatgggcagcacaccaggcctcccttgtccttcactatcttctggagtttgctccaactcatgtccattgagtcgatgatgccatctaaccatctcatcctctgtcaccgccttcttctcctgccttcaatctttcccagcatcagggtcttttccaatgagttggctcttcgcatcaggtgtccaaagtgggtggttagtggtatcaatttctaaaattaggagaactgattagtttgtagatcatctgtaaagacagggcttatgttcacgagacaagtccaaggggctaaagtcttctctgaagggtggaaaccacactcctaacagagaaaccttcaggatgggccacttcctctccactgtccccaggcagtcccccagcctttccaaaagaagtgtttggagaggctacatggccatggccctcggtgagaactctgttttgaaagtgacagaaacctaactctgaatttcataggcacaaaggatgatttagtggcttgcagaatgcaaggaattaacccatgggaatggaccagagagcagctgggcctgttctcctctctgcctctccccacatcccagcttttccattccaaccacaaaccaacttcttccccaaggcaggaagcactgaatcctcaggatttttaaaaaagaggaatcaacttttttcaaaattgtttttctcttcaatagaccacctttggtctaaaaatattaagaaatgtgacaatgaagtttgtgaatgaaaccacgacacaaatggagtagtttgtttactactcaaaatcacattagtaaaaaacttcactcttctaaaaatgattcacatacaaaagtagtaaaactagtctaaaacaggaaaaatataatgtgaaaaaatttataaaagcatcctctcagtttttatattctgtaacttccaatgactctcatttccagttgaaaaacttaagagaattttaattggctagggttgaattatatgctactgttgggcccatcagctttgccacgggtggggtttctataagaatatgacagctcacactatgtccacagctcacactaaggaagggctatgatgcccaagagacagagatgattagacaatgctcttttacatgatatgggtcagcagaattcccaaccagagagatgaaagggaaccatgagaacaaggaaaaatttgcaaattttggagaactgagcagtttttacttggagttccaggaaggacagccagagaaatgcccacggccctcaaagctatctactgagagcagaagataaaaatcattgtcctgatggagtttgtctgtgtgtgtgagaaaccagaggggcagtgtccagactcgaactggttgagtagggttccaatgatgcccaactgtaatatctggtaaacccttatctccccccagagactggcgttgccagtcaaagagcctgcagatggaacctgaattggcaaagcagacagaagtggaaggtagtcagtcgattgccttccaatgagtgggaggctctcgagcccctcactagccatgcagtcttggataagttagatttcacatctctgagcctcggtgtgctctgattttaaatagtgaatgtgcaaaaattaaagaaaatggtgaaagtgtaaaattaaataaggtataaaggagagtgcctctctcataaggtcaagtgaagagatgatgatataatgcaaggaaaatacctgctacagaggctggcacatagtatgtgcccaataatatcatctaatgctttcatcactgctacagaggaggtgtgtgaagtgggtaggtctgagagctttccgttaacgtttaaaaaaatatttatttatcgctgtgggtgagctttctccagttgaaacgagtgtggtctactctctggttgtgcagacttctctcattgcagagcaaggactctagagtgcgctggcttcagcagctgtggcccacaggcttagttgccttgaggtgtatggaatcttccctgaccaggaattgaacccctgtcccctgcactggcaggcagattaccagggaagtccttccattaacttttgagtgcctcctagaggacagtttcaatatgggaggctttcattcttggcattgactccaccccaggcaactgtaatagcaactttattctctgatccacctgctaagtgtcaggcactgggctaggtactttacctctattatctcatttttgagcattatcagcaatgactcgagacagtgtatcagttagcttctgctgcataataaaccacccccacactcatagcttgtaacagcaaccccttacaaagctcatgattttaaggttgggacatccagcgaggctcttctggtcttggctgggcctgctcatacatctgcagctgctagttaagtggctccacttctgggagttgcctggctgtcatctgggtgatggggatgactgagccatgtgtcttttttcatccagcagagtagcccgagctttttcacagagaagctgggcagggttccaagagaacatatgaaagtgtgcaagacctcttaaggcttgggttccaaactggcactggcgcttccaccaccttcaggtggccagagcaggtcacagggacgtcccagattcaagctggtggggagaagcttcacggtgagattgcatcaggtgggctcagaaagaggcggagaaatgtggctgatcttgcagtatcaggctttccttgtgactcagctggtaaagaatccgcctgcagtgcgggagatctgggttcgatccctgggttgggaagatcttctggagacgcgaaaggccactccagtattctggcctgaagaattccaaggactgtttagtccatggggtcacaaagagccggacacgactgagcaactttcactttccttcctttgcagtataccactggtatactacaagataggtactggtattactgccatttcacacgtgagaaaattgagactcaaaggggtaaaaatgtcttgccccagtgatgctgctagtaagcatggcagaagcaggatttgaacttggggggtctccacactcaactgcattgggacatgcaaactccattctctcaacggaagcacccttgtctggcacagtccacaagggcccaatctaacaggcaccagaggacttgactgagatgagggcggggcgggagcaaataaagagatgaactggaagaaggacaggagcaagggattcagacagagcctgtggccacgacaaggatgccagcttggcgacgtggacatcagcctgcctcatgaagccacagaactggacaggccaggccagggctgaccttcttccaggcagaaaccctgcctgcacctcacgctgacagggccctgcggtgagcctacggtaaaggagctgcctctgctgcctgctgccgagtcctcagaccatgggtggtgacagtgctggccagaagatcaaagaagtgtcacaggtgaaagcagagatctgttctcctgtgagcattcagagcactccaagctggtctctgtgtctgtgccgagggtgagcagagagacactgggctggccgtgaggcgccccacctcctcacctcccctgtgaccggcccctcccccacagagaaacccacgccaggagcacagctgtgcccagccaagctgccgggtgccaagccgggcctggcgggctccctctcatctgtctctctttagcaggaacaaatgggaatgagggaatcaattaacaaggctccttagccaaatgactgctgctccctccttccccagcctgttaacccttcgctgccagggccgggaagggctgccccggctggccgaccgcactcagccctggggcccccatctggatgccgcgctcctgccttgtctgtgccaagtgctggcagcagctgccaagctgaggaaccagagccagaaacacagacacctccattcaacctcagtggaatctggggtcaggctcaaaggatcttcagggcctccggcctggccctttcttttctctccagagacccagggcctcctcctgcatcaaaaaccactgagaagaaggttcaggccgggagggtggctcacggccaaacctgacctggggcccctactgggtctaggaaagggtaggggcccaggggacagggcaggacaccttgggccacactcaggaagccctgacacctcgaatgtcaggagcaaatggtcagtctaagaatcctctcagcggaatttggacaggcaactgtgggggcctggttgtcaggaggcctgagttcaagttccggcttaacagctgacatggggtctgatgatattttgaatgattaatcaataggccactctttctcccacccactctcaccaaatgtctttatttgtcctccaagggtcttttgtctttcaccattcccactgtcccttccccacccaaccccaacccgccagccctgcctcagtagtcaggctttggtttgagctgctgctgctttaccggattcaggactgccatgcaaagcctgatccaccatatgctgcggcactggggtcacagagaaacaggggtgtgctcttggccttttttatattcaaaagatactcaggttctaagttcagaccaaaaaactcagatgcagctcacatggagagaaccacctgcacccaccccctggattggataaaagactccaaaggctggaagaaggtggcaaaggggaccagagaggacatgtcagcaggaaggactgcctacccagccctgacactggagagtgagctctgggcccagcaaggcctgagacacattcatccatccattcattcattcatttgacaaatggacagtgactactttctgtatgccagacactgttctgggcacagtggatgagcaacaaggaccctggccttgggcagggtgaggctgaggacatgagagtcactcagtgatggccctcagccatttatccagcaattgtccagcaggagggaggctgttggtgccctgagttttgcctcagcagcaccctaggtcacccaatggacacggcaccatcctgcccggcttctatccccaggacacttgtgagccacctgggtgaagatgggtcctagacaagcaggggatgataagaggacgggaggagaggcctgagaggagactgccagcaagccaaggtcatgctgaagccacaggactgcccctccctgcccctaacacattggccagtctcctttctaaaactcaccttgggcccaagttcaaaactccagccacaactggcctggtgtgaatcagaagcccatcactaagccaatcagcactgcccaggagtagggatctataaacaatggcagctcccattcccagagcagggtgagcatggggggaaatggttccctgaagacaaaaccaccaaaggccacaatactgaccttggtcgggcaggtggaaataggttgagcctcacttctctgacctgtaaaatgaagctgatgagagtgccagcctcactgggctatctttagggttaaaggagcccattcagatgagagcgctttgcacacaacaggtacagaaggaatgagagtcaattctctgtcctcagtcactccctctctaaaatgggtgggtgccctggctcatttccccagccctgatgtcccaggatcccacagccctgagcctccatgacaggcatgagcgatcacagactctcctctcagaggtcaggatccccttctgttcctcaggactgggaaaatcctctggctgctcttcatcttccccacttcagtctccccaggccctatgactgtcccccccaccccccaaccctctgagtttctgcctggagaagtggatgtgccaatgtgcagagcttgaaccagagttcagatcccagttctgctgctgcctcaaggctggatgatcttggtcaggcttcttcacccctcagtgcctctgcttcctcatctgtaacagagaacttaactacaatagacactgccccgtgggggcgctgtttctgtgtcgggccctatgcacacgtgctaagtcacttcagtcatgtccaattctttgctaccctatggactgtagcccgccaggcttctctgtccatgggattctccaggcaagaatactggagtgggttgccatgccctccttcaggggatcttccccacccagggatcgaaccagcgtctcttatgtctcttgcattggcaggcaggttctttaccgctagcatcacctgggaagcccttaaggccctataagtatcagctattcaggttctcatctctgttggctcctggaccaccccattgggaagtagcttggatggtaggagtgagccaagcactgggcacagaggggtgccccagactgactgctgccaccctggcctccttgagttccccacctggtggaggcagacgcatcagcaggcaatctcagtgcagagagaccagggccactctctagggaagcctggggagaagtgtgcacaagattggcccaagccaaggagggaaaccaaggcctgctgggactggtgacaaccggaagctagtacaagtgggctgggtgaaggggggttcaggataggggtccaagcagaggggtcaactgtatagggaactcagccatgagagcgggccaggagacagcatggaggacccagggtgctggcagctgcactccagattgtggagcctcagggcctgcctcgcacaggactctgtgtctgggtgtgactttgtgtaatcgactggggctgtgtgtgtatgtgtgtggctgtgtggtggctggtgtgcttgtggatttgtttctgtgagggactgtgtgtgacagtgtgaaatagtgtgtttcgaagagggcggagcttggcatgcctgtctgagatggtttagggggcgatcactgcggctgaccactgtgtgtgactgtgtgtccatgggtgtccctaaggtgtagataagtagccgctggctgtgagcaggactatatgcatgtatggtatttataggtatatacatggaaggtgaatgtgtgcgtatctctgtgtaggtgtgtgtgtgtgtgtagacatgtgtactgctgtctgtggagtccagggcaatgagagctgctcctccttccagcctggctgcacacgcacgggcgcgcgcgcgcgcacacacacatacacaccacacacacacacacactcacggggctgggaggggtggctgcccgttgctgccacagccagtcagaacttgctaatttgcatgttaatgaagctcgggagctctccagctcgagactgacaggagcccccggcgcccccccacatccttccctgacgggcctgggagggggggagtggggagggctgagaaccggcggagggaagaagaggcggaggaggctctcactgtagcttccctttctctctccctttctccctctcccacccctgtgccggccccaggccccaccacgtgtctgcccgcccctcagccccccttcactctccctcctggcccagcacagggagagggggctggggcaaagcccccggggcaatggcagaggaggctgccaaggttcccctgaggtgaggctgggttgcctacccctgcctctcagggagcacccagcagaccagccataggcacccacccaggagcagacaccccgggatgggacatctgagagtggaggggtgccaacacaggcaacaggccgccctcctgtctcccccgcccccgcaggcttcagtgcggccaaggtgggtcaccacgagctcttccgcctgcacccccgagaaagggtcagtccatgcgaggtcagagctcccgcccagggcggggtggggggtggcagggatggcacgaggactctggagatacaacgtggggggagggactggggtacacatggaaggtgcctccctccccccagggctgtgctcgcagggaaggaaggctgggtggggtggtgagtaggagatgggagccctcacagctttgatcaacaggtcagtcctggttgcgcggctgtctcctgctcagtctgttccttaccgcattcttgtctgatcccggtccttcaccgtcccatccccctaccactcctgccccatcccctccttcctttcttaatcagccacatcccacaggaggctgagctctctggggagcccttggcagccgcctcctagaaacactgtctggttttgtctcagaggtgtgtcccctgccttgacagagagctggtctgggctgggggtcctggctcctgccctctcagcctggctcccaatgagcattttctccttcctctgccttcccttccccaacattgctctgggcactgggtctggctccctgcccctctgtctctccctgagcccaagtctctatctctccctccttttccccagatgctcaaatattcatcttctctccccacccccagtctctctttctgccttgccctgtaggtctctaaacacccacccctgcccctactcccatctccccctgcccccccacccccggtggcaggcctggcccccaggtgtgtctttgccagagaggggaggcagagaggtgaggacccctcaggccctgaatctctgcaggtgagaggggagctgggcagttgctggtgttaattgcagggaggatgtctggcagaaataaggtggtttttctgcttcagtgacgactgttacaatcaaattgtccacagacaattagcggagtgggagaaataagaattagatttctaattattttcccagtaaaagccgccctggaccccgtgggtgagggggaagggcttctcagtggagccaacaggcacttttgtaggccctgctccctggggtgggggagcctcatgggagctccccaggcaggcaggaaggggctggaaagggcagagaatccggacacttggatctcagaaccagccgccatgggacttgctggcacttctcattttttgagccttagttttctctttccagaatgggggaacaaccattcctaagtagcagaattgttgtgaggagtcaaagaggtgaagcagcccccagtacaactcacgactcacacacgcctctgtggacttgcaagctcgcacactcacacactggggaagtttctccttccaccccctttgctgctctgggtctgtgtgtgtgacacatgccggggactcagggaaagggggcctgaacccaaggagagcctcactcaacagcgtgtgcctccctgagctgtgagcctccatctccacatctctcacatgaggttacgcatggtgccttccacctgggctgaaatgaaggttaagtgacacccacgatgggggcgagcctcagacctggccccacggcaagtgctcagtaaaatgaaagtcctatccaagggggccagcccgggcctgcggggctggacacagggctctgtgcagagtgttctgggtccaccagacccaaccttcctctggggcctaatcactcagagaagtgaacagaaaaccaagccaagaaggacccaccctacggatcagatagttctgggttgtgtctgggctgtgtgctttctagctagtcaggcagtgtctacatcccctctctgaacctcagttttctcttctgtaaagtgggacaacagcagtggcttcctctaggagttgctccaaggctgtgacattaatttgctcctggtaggtgctttaggagcgggaggggctagaggcacaatcgccctgactggaacaccatcccccatcccccacccttgtcctgcacagagtcaaggactaagggtgggagcctccgggttgccctaggcctttaggacctactccccatggagcagagggaacacccagctcactaatgtcctcagggcccagactagtgacagtcaacacacctgcacacagaagcgcccatgcaggtgccacacctgaccgcactcttgctgtcacgtttgtgcatgcatctcaaacgctcacacgcacacatacacccttcctgatgcggccagaatgtccccatatgaaccaaggggaagctcctggccacacccacgggggatgagccgggagaggcagctgcaagccagctgtggggtctggagtgggcgaggggagctgcttggatacccagctgggagtcgggcaggagggcttctcagctgtctcttggctccaggcccccttcctacctctgggggccagctggcccagctgggcagggtggaggtcacctgcctggaggtgcctgtttctctctgcccctccccgcggcctttcattcagcaacaatacctgggaccccgcccaccttctgtgccatctcccccctcccttcccactctctgtctctctgtctctctgactccttctgtctctccctgggtccctggatcttgtctctctgggcctgggtctccccgccccagtgctgggctatgtaaatgtggtatttcccgtgtctcatcagcaggactgcctgcttggctcacatttaatttgatccgtggcggcgcctctgcggagccactcatcaaagcgggaagacaattaggtgaatgtcagggtggcctaggccccacggggtgaccagggcctggggctggggccatgaagtgtgaggggcaggggcctggctgccaccctcatctccctcggggcctgtccagacttggcccaacgtctgcgggctggccagccgcctggatggcccctgtgaagaccaagctcctctctgcccaggacctgcagcactgaggaactgaggggcatggctggagctcctggacttggcagaaccccctcctcacccccaaaaggaggcagctgtgtggctacagtcaggtggactcctgggctgggccctcgacaggcctggtagagggtctgagctctgagctagctcagggtcccctgagaagggaatgcattctttccaccagccccgcccggcgcgcccttgctggcgccaagccagcggtcctctcctgagcctcagcttggccttttctcctccctcctctgtgttgcttcctctccttctgtctttctttctctggctgttattgtgtctcttccccctctctacttctttcctcagtctcattcctttattcccaacctctccttttctgtatcttataccacccccacccacccccatcatgtccttggcctcctgggaccctttagcctcagctgctcatctgtaattccccatccctgtccctggctgatccttccccacctgaggctgacctgctaggtaaatctgaactccctgccccagcctgacttcctcctcactgcccccgaccctcagggatccctgaatctctgacacctccctccctactggcttcttcatgttagctgtcaacacattcaagtctctcctgttttaaaaacgataataataataaaatgccttttaaagagatactctccttgatggccccactgcttcctccacagcccctttctctcctctccctctagggaagcttctgggagagcaatctactcttgcttctgacccccttccaagctggcttcgggaccacccctcaggccctagaaacagtcctcaggaaggtcaccagcaaccttctcatcactcagcccccttgatcacacctcacttggatgcccagacagcatctgaacaactgacttctctcttcttgactctcccttattcacacaatgcctctgggttttgcctccacccctttggcctgccccttcctggaccccacctctgccctggcctcacagttgccctccagagccatcccagctcctcttctccattcaccctctgtacagctccttaagtaatttaacccatgccctgctcccccgacccaggcttcagtcacacttgtgtctacacctttggccttctgctctagcccagctctttcttctgcgcttaggacgcaactattcactgcctcctggcccctccctgcgtgttccatggccctcccaaacccagagcagcccaaaccctgacctttcaagcctgtttctccttttgggttccccagttggatgactggcactttcatctcccagtttcccaaatcagaaacctggaggtgaaaccagagctcctttcccccaccactttcacacagtgggtgataacagacgacagagtctgcctccaaaatatttctcttctataaagccttgaaagtccaccctcactttccccatcctccctaggcagacctgctcaagccaagatgttctcattgttcccttggaggcatcttaatgcttttccacctgcaagtgtttactactttttatccccacatggaatgcccactttctcttctttgcctaacccatgtcaaatccatcttgcccctcttcttaaaagcctagctccagccccctgcaaggaagttctcttccctccatcccagctggcagaaccttctcccaccctaagctcatgaacccttcttgtctggtgcctggacacacaggatcatctccgctctttctcctatatacatggtctcctacatttcccaggctccttggtaagtgggccatgtgaatgcttctggccaatgagctagagataaaggtgaaatggtcacttcccagccaaagcatacaagagctagtgtgcaatcttctagctgccacagcaaccaacctctttggagatggtagagcctcaagatcaaagcagcatggaaagctgagtcccctcatgaaggacaagagccctcagatgcctggtcctgcagcagactttgtttaagcaagaaataaacttttgttgtgttcacccactgtgattgaggggttgttggttaccgcagcatagcctttcctatcctgactaatacaggccttttggagtgttattttcccatctcttgtctgaggataacattctgctctcactgtggtagtgagaattaaagtattaaaacatccacattcagcttctgagtgcctgctgcatgtcagactcagtataagtacctgactatgagatctcctagctggaaaagtattatgaactgaatgcttgtgtcctgaccgcccccctcctcaagttcatatgttgagacccactactatggtgtttgaaggtggtgggcctttgggagataattaggcttatatgaggtcataagcgtggaaccctccgtgatggtattagtgtccttgtgagaaaaggaaaccttaaggaagccattgcaagccaggaagcaccaaaaatcaaatttgtcagcaccttgatcttggacttcccagcctccggatgtgggagaaataaatgtttgttgtttgagacacccagtctatggtactttgttacagcagcccaagcagactaagacagcagggctccatttatcagagagaagagaagatagctacattcagctgctcaggttgggtactgaacaatcccagcggggaggggcactggcagagattataatgtggaagtcactccctggagctgtgaactgtagaaaccctgttgtcctcctagttacagtgttgctttaaatcactgataaacattgacactaattttgtagttataaagaggaagagttggggtggggagggggcttgaaaaaggcacgggagaaacaggaacaatgcttgtaatttcatagtattaataaaaaataatgatgtcaggaaaatttcacatcgtgctgctatgtgccaggtactactccaaggctttcatttacatttattcatccatttctcacagcagccctatgagataaacatcatcatcccccatcttacagatgaggaaattgagtcagagataaataacccaacatcacgtggcttataaatagcaaagctaggatttgaactggggcttccaaggtaaagaacacgcctgccagtgcaggagacataagagacgtggattcagtccctgggtcgggaagatcccctggaggagggcatggcaacccactccagtattcttgcctggagaatcccatggatagaggagcttggtgggctgcaatccactgggtcacagagttggacacaactgctaagtgacttagcacacatccacaggatttgaatccgggcgttttggtttcagaattgctctcaatccctctcctgttcgggctcctaaaatgaggataatgtgcaattcctcccccacctagggcctggcctggatttgagcttccagggttaggatgagggcaaatgctaaagcaactgattttatgagggtgtctgagaggacatgtgcacagctctctggggcccagggcacaaggcacagagctgagcaggaactcagcccccttcaccacttccattcctgtaacccccacctcctgctaccttggcctccgtacagaccccagaagcaccgtggcatccaaagggcagggcatttgaaatattcaggggccacccctttggcctggcattgatgggagggacagaagggaagattctccacacatgttgaagggtggcagatgggcataaacaggagtttgggcaggacaaattccaagcctgaatcctttgagcataataataaatgcaaatgtgacctctcacattctcaaaggtccttcagcttgtgacatatcatgctacagacaggaactcattcagttcttatatcaacccatttcacagatgaagaaaccaagcatcagagaacttgaatgcccagagtcattcagccattaggtagcagagtctggcagatccagggttcacacaatgtccacatctccagctacccccagaagtgccagtcctcttgagagaattccccatgtccccaagggtacctcctactgggaaccagggtatccaggtctcctgcaacctggcaggggtctgtctactagggtgagcctttgcttcacccgcccacccgtgtgctagggacagaagggggactttatgtgcaatctgcctgactctccagaaagcacttaggtttacgatgtgcatgaaattgatcgccagttggcgcggcccccgcgcgctcagtgccagcccagtgctggcaggaggctgccccccaccccccactttcaaggagcatcaaagccgcctgccaaggcccctcgtgagggtccttctccactaacaagtgctgagtggcggggggagctgtgcccaaagacctttccacagcacacatacccccgccccacagtagttaaatagctccatgttttatgccaattcctgcctcttctgcttcctctctaacaagctgatgctttcaaaggccccactaattggtgtttgcacctcacacaccacgacactttgatagtcacttaggacatgggtccgtccatcacacccttggtacagagggtggttcacctccctgcagcaaggtgcccagcctgggtgctcctgctcctgtgcgcacacaggagagggcccgcgtgccttatgctgtatgtggaggacacgtctgcacatatatgtgcacgtgggtataaaaactccttcagaatatctcttgtgtatattcctgcttgcgtgtcagtgcgcgtgcatgggtgaacactaccatctgtgcgtgtgggagtatgcagtgtgtgcctgtacatttccctgggcgtgtttgtgtacccacgtgatagagcttgtatgtgttgatgcatgcactcgtatgctttgcatgtttgtgtgtggatatctgcttgcaggcaggccggtacttgggaatttttgcaagttgactaacaaggtacatgttcatgtatccatgggtgtatgggtttgcatgcctaagtgcaggggagggtagacacgtccatctgtgtgcccatgcacaggcagggtgcagggatgagggaatctctggttgggcaatctacatagcacgcatgtacttgggcatatgctgtgtgaagaaaaggtgtaatacaatagtcaagggcccacaggctttgggttcgagacccggctctgccactttctagctgtgtgactttgtgatgaccactgaacctctctagtcacatctgcttatctgtaaaatggggatgataaaagcatctgtctcatattgctgttctgagaatcaaatgagataatacacgtagagggctagtccgatcttctctcattgctgggcacacacaaccccatctggcctcaacacggagttgactgcccaggagagaccctgggcacttggggagagaaatggccagccccagaccacacagtaacagctacaacctctgagatcttcatcacatccaaagtgatttcacacttttattacctacctttgaataggtgggaaactgaggtgctgaagtaggtgggagtcggtggcagagcaggaacttgctgtcagaagacagcctacagctgagctgtgggaagctgggatgtccctcatttccaagggagagggggcggcttcagaaggatggagtaatgcacacacccgtgcgccctatgcaccaacacacgactcagaacaaaggggtttccttacctgtcccagcctggggtgcctgcctcgggggagcatccctgctggggactcaggctgagtactgccacccccagggtgcccagccatgtcccttctgtaaacccagctgtagttgtgtctgatctgtgttatcttctcaccaagacactgaggcacagagaggggaagaagcttgttcaaggacatgggacagaaaagagcagaagcccccagcaggcaggccaggattctcatctcttgctctcctccttcaccatgcagccttcactgcaccaaccaggctggcgaatcaggggtcggggcaaagtcctccccacggcaggtcatagggccttcaaacccacccaaaggtcatattttgcagggtgatttttttatgctactttttaataaaattttaaaaacatgaaaacttaaaatcacaaccagtagcagcagcagccctgcttccttgccagtcaacattgcctctgtcattaacactgccttccccctgagccatcaccctctccagcatcagtctgactgtgcccccacctccaactcccaccccttaaactgtggttacccccagcccttcattagtgtctcggacttggccccaaaaccaagcagaaatggttttctgccaccctttgcatttcatttctcctcccaccctcggggcttattccaggatcatctgacctgaagcccttcccagatctgtaaccctccctgctcccctgagcccctggcctcgcctgtcctgcagaaactgcgggctgggctttggccctgaaggcctcactgggggctggcagccaacaagggagccaggaggggcaggagggccaagcagccccctccccaggcctggcgccccacccacccagccggcggcctgtctgccttcctgagctcattaactgcaggtcaccgttcagcaggaaagacaaggcgtgggttctgcgggcgttcattagccgtgagaggaacagtgtgtgtgaaattagcagtcacctgaggacctcgataatttcataattaggaggcctaatggctccagctctggatgccaaatgacttaaccccttgcctgctgagctcctaacccccagtccaaggctgcagtcccctccccctgtgcctcagtcctgtttatttccaccaccacggtgcccagcaccagagttggcacaaaggggctgtgagagcaaagttgatggagcaaatgaatgaatgaatgaatgaagacgtatctgaatgggaaaagagcttcagcccccactgcaggtgatcaggggaggaatgagtctccatctgtaggcatagatgtgtggttgtgtgtgtgactgtgtgtttgtgtgcacgcacacacgcatgtgtgggcataagggcacacacacatgtggatctctgctgtccgcttctaagagccttgtgtgtgtctgggtgcacactcacatctatgatactcattctgctgcctcctgtgctctgcaggtgctctgcgatgaggccccatgtgcctccttgaagtcagcctcccttggcaccgcctaaatactggtgactccataatttctatatggagcacttggaaggaaaagcaggcctcgggagcttaacctgaacctgcatttgcatagccaatataccatttttatttagactgaatgttcatttggggggctggtgttaataaagacagggggctaaagccatatcgtttagtatggggagctatcctgacagcctccaaaaccccccagcctctctcagcctgctcttcttcctcccaacctttctgtggccctgaagaggtgggggctgaggtggaaggcagatcacaccggggtccaaaggctggatcaggctctgcctaatctgggaaccaccgattctgaggatctggtgaccccgcctccctccgcaaatggtggagtggtggttggagaagaggtgagtgtggtgaaagaggaggggaatgagaagagggacaggaagaggttgggggagaacaagaaagggatgggagaacagaaggggaagagggcagaaaggatgggaagtcccaaggaggtgagagggaaaaagagaggagagagaagagaggaggggaggggcgaggaggagaggcaaggaggctgagagcattatcagcacttaaaaagcgagcagctcagttcttctttggcacaaataatggctttttatgaataaatcatgtgtcagacgcctcccagggagtgggcatggaggggggcgcgtctgcggggctccgaggctggcggggaagggccggttgcagacccccggctacaggggtactgcccgctttctcctcatggggcccagcaggacagagctgtctctggaattaccactggcctgagccaggaggagatcagcccttcctctgaggtggtcccgctgctccctgcgcaggagtccagcccatcccagggctgggagtgtccctccgctctgctaccctcccatcgcagagccgcccagaagatgctcctggaagggggacaccagctctcatccaccccgagagagggggtgggccaagacaggaagacacacccagagagggaggcgggcagtgcacacaactcacacaggcatggtctctaccacccggggcgcacatgtgggcacactcggagatggaaacactgtcattcctaccacacatacacacatgcatgcgcacacacatacaaatgctcagacgtgtgcacactcagacagggagaccccaaccaaccctcagcccaccctctctcccagcacacttacacttacacacacacacacacacacatgggcccacacagacagatgcatatggtgcttcatggacacacacagacctgcacacgcacatgcatgcgcacacacatacaaatgctcagacgtgtgcacactcagacagggagaccccaaccaaccctcagcccaccctctctcccagcacacttacacttacacacacacacacacacacatgggcccacacagacagatgcatatggtgcttcatggacacacacagacctgcacacgcacagcagccacccacactccatcagcctagggtgggggcagttttgcaacccatctggagcccagacccagctgggctgtccctgagtctgggtgtggggtggggctggggcatcagtccctggagagagctcatctctgtggtccccacccagcaaggatgacacctgccacaccccacagggaggtcctgccatcctgaaccaagaccagaaccagtacaggctctgctggctccgatctccttgactgtctgctcagccacctccagtcagtgggtgccacaggacagcctgggcagctctgccccttgccaggagtttgacctcggggaataattccaatttcatatgcccctgaaaacaaatctaagataggtgctactgccccatcttctagacctagaaactgaggctccaagagtaagagcactgggcatttctttcaaagaccatgccctttcacaaactctaggagcccacagtgtcctggtcttccttctctccctgtgccaaggtgttctgaggtgctcacctgagcagacctgggtggcccgctcctcccactctgcaccatcccccaggccactcccagcacctccgtgacaacctccacactcttgcttctctgacctccctgtccagcccacaccttcctgggcttctgaccttattatccagctggacatcactgggtcaccatgttgcccaacgccagggaatgccattcacgcaatacatacgttcccaaacattccccccaaatctcaaggggtcccataagacacactgaaaagtcagcccataaggctgagcgcactgtcttccccaggactctccctgcgtcagagttctcaggggaagagccctgtctgcccaagtgcccaaccagaatcagacatcatttgatcctcattccttatgtccaacctacaaccaagtctcaatgactctagagccaaaatatatgtgtgaaattatcctttcccctccagccccactgccctcccttgtcccttctcgtgtgagtcaccaccagcacctctggcctagccactggccctctcccattgttgtcccttctggtctacctgcctccctatcactggtcatccttctatctctgagctctggccatgctaaattgctttttgttctggaacccaaatgatcccttgactctggatctctgatcaagccattccctctgtctgaattctttcctttcccagtgacaactcaccctttaaggcttggctgagacagcacccccacccccaccccaggcaccttccctgagtcctcaagcccaagatgtgtgcagctgtgtcattcgattctcctccattcattacatctctgatctaaaattgcccattaactcatctctgtccccctcaaacctcttagttccttcagagcagagactgtgcctgtgctgctctccggcagccccagtgattggtatgagacctggcacatagcaggtgctcacgaaatcttccatggatgaacggatggatgagtgggcacaggacctgtgctgccactttgcatatctcttctcatttactgctcacgaggtgtgccagccaggaaagcaaggttacagaggttgaaaacttgtgcaaggtcacacgactggaaaatagtagaggataaattcaaacagaagtctgtgtgccttccagggcctcctttccaccatcccagcctgccttgccaggccattttcctgctccgactctattttctcatctgtacaatgggaacaaaaattacacctaacccaggatctgacacagacatgctctcagttaatatctgtgccttctcttccaactctagctttttggggacagaatatccccagaccagaaacttcccgcaaggcacatgttcacagaaacaggtggagagtccacccaggcacatctccagcatccagaactcagtaggcgcttaaccaatgtgtgttgagcagataggcgtccgtgaatgctgacacagatgcagacacaaagtcacaatgggctcaggcacagggacccccgcctccccgatccttgccaattatctgcctccgccgccgctctcctgctagcccaaggcgcgggaaatatttaaaacaattttattcatgaaaatatgctgtacaatgcactctacacggcctcgacacggcacacacgcacacgctgacggcacggccacggtacactgcctacgatatgcgccggggacaccgcgcccacagcccgccccgaccggacacttataaatatgggagagaggagccaggactggcacggagaaaggggtgatgggttggggagtggatccagagctgaggctagctggagaggctgaaaccagtactgggggacgggcaggggtggaaggggagagggacttcgaccgggaggggagaaacaagggcaggcgaggatgagtgggaagggctgaaccgtgggggtggaggtcggagggtggttcaggacttgaaggacagctcaaggtgaacagccgataggtgagtgtgggtgtgttttcaggagaggggttcctggcttgaggtgggtgacgcaaagaccagtgggaaagtgtcaatagggaatcagccccgactttgggtgggcgattagtcactcgagagccctaccaatgatactgaggattcggagacgcccccctgtcgcatctcccagtctgcttcccagaccagcgcgtcccacctcattcctccccattcccacccagccgggaacccagcatccaccccgcaggcttcccgtctttgggaggaggcagagctggcctctggggcttgggcaggaatagcagggtgctccagcgcctgcctaccacttccctcagcggtcagcttctgcgggctgtctctagctgggttggggctgcctcctggatccccccgtggagcggaaatgggaatggggacccggggatcaggatgggaagacagaggcccctgggggggtggggtgcggggcagggcacctggggcgcgcggcaggcggccctcagcctggcacccagctctggttggggggcggggctccggccaggccgggcggcggcggcggcagggccgagtcgaagttgaagtccatttcgtcgctgtccatgaagtcgttgaggatgatggactcgacgtcgcactcgaggctcccgctgaacatgtcgaggtccaggtcggccgggaagcggtcgggcgcggcacccagcggcccggcggcggcggcggcgtacggcccgggcagcgcgtctagcaggaggccgccggggggtcccccgaagacggccgcgtgtcccggcggcgccagacccgtcgcgcccgcctcgccgggcagcgtcataaggctgatggggtgggctaaggcactgcgcgagggcgccggcggcgcgtacggggccacccctttgccagggtaggtgccggcagcgcccgccagcgccagctccccgggtgcaccaagcacggggccggccctgggcgcgggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgcacgcggataaaccgggtgtgcagagacaggttgtgccggatggagttctgtggccagagacaaggacaggggtggaggagtgggcagtgaggggataaatgatgggaagaggagtgggagaaaatcgaggagaggaggagagaaggcgaaaagaaacgccaagaagcagaaggggaggaaagagggaagatgaaagggtacagcggggaagaagggggaacaggtgtaagtaccaggtaggacaaactcagaatatccatcccccaccccagaaccgccccaccctccctgttcgcagcccgcacaggcactgtctgtaggatggggccggagctttgggtctagtcttgccagggaggctactcttgaggagccgcctgcagcaggggagcaagacccctctccccaactcagccaagctctgcccggggctagccaggctgctagggccccccaacagattatgtaagggctcatgccgctgcggctcatttgtccgccccccccccccccagcctggcgtggcgccaggagcccgaaaacccagggctccagaaatcaatctcgcggtgactgattaagccctgtttagaactaattgctctttcgtgtgtggggagaataaattacctgctttaatttcgtgtctttaaaatgcaactgcaggtagagaagactgttaaccctttgctggaagggtctggccaggataagcagaatcggctgggtgtccccaaggtgggcagaggcccacattttctccccaattctcggagcttctgcgaactccactccgatcccaggacacccctcaaagcacatccatcagccgtggagacctcaaaccccacagctgctcagtacccaccttcaggtcagcccagttcctttccctccccacccacctgatgcaaagtagctttgccctcaagccccttcctgcacaaaatccccacaaagcaggtgacatcatgcccatttacagacaagaagactgaggctcagagagatgaagtggcttgccttaggccacaaagctctcctgctgtgtctggtccttcctcgggcttcaccttagccacacctacacatatcttcttgtaaatttctgttgggctccatatcactgcctacttttgccaggcctggcctggggacagagggaggcaggggagtccacagctccactgacctggctcctcacagagaacatggaggactagaactactgcagagcctaccacgccccacctctggggcctccctgctggaggcctggactccctggctctggcactgttgtggaaatagcaggggtttgggtatctgaagggctgggcaggatgcctggctcttttcagccacctagctatgtgaccatggctgttgactcaatctctaggagtgcatacctcagtgagctgctctgaaaaaaatgggcaacatacagtaaccacctcggaaagctgttagatcattacctgagataatgtgcatgctaagtgtttggtgttcataaatgttggtcaaatccctcactctggccagaagacctcacttcttagatcactccacagacttactccttctctacaattcttaatatcaggccctgagtgtacctgcgctgggcacaaacaactctggggagctggcattaccccatctcctgtaccagggaatggaggcccagaggcatgatgtaacttgcccacggtcccacaggcaccactccaggtctgcccagcatacggacctgctctcatccccccagccccagaacctctgatccgtccaggctctccctgctgcctccttcccacctgactgcaggaggggtcctctctgctgcccagggcgcccacttgcccctcacccccagcaccaggcacgcacctgacttcttcagggccccaggctccttatctctggcactttctggtcttgggagacaacagctggggccccaaggcccctcccagcattgccctgcctggctcctcctggggccctgagaggaggggacccagacccccagggagtggtgctccctggagtagaaacccccctttcctgctcccgcccctgcacctggctccccagcccctccccaacacctgtgttcagggacctctgaggcctcagttctcaacccctgtgggactaactgcctagccagaggctccacctcgcagcccctccagctggaggtcagtcaggccacacctctttatccatgtcactatgtgccagcccggttctgagtgctggagggtgggaggagaaggaaggatgtcaccaagtagggcatctcctgagtacctgccgggtcagccctggtattgggagtattttatcccattctcagtactttatgatcattctgtcagtgttcatataactcagggactgtgacccctatctcaagatgttctagggaaatagcaacccactccagtattcctgcctggagaatcccacacacagaggagcctggcaggctacagtccatggggttgcagagttggacatgacttgatgactaaaccaccaaccatctcaaggtgaggtgactgagagagattacgtaagttgtcaagatcatacagttttaagtggcagagccaggcactgatttcaggttagactcactctgagtctaaaggacctcacattccaccatgggagagagaacaagtcagagaatttccaaagaatcttaggaaaccagtcctccatttcttctcaaactttccatgatgtaatcaaccctagaagctggtagcatgggaagctgggggcatgttaaaaggtcaaaattctctaagagtcttgcgtttcctttttagaattcaagggaatcttggcttgtattccacgagacttccaaattttctgaatatcaatacaaatgttttagatcaccgtcaagaacacacattccaggcctatgaaggtctctatccttccccactctgttccttgcccagccaggtacccctaagccccagcctgaaaccacagctggttggacccagagagaaaaaaggacttgccctgcatcacccaggacctggtggcagagctgggattcaagcccaggcctcctgacctgcagcttggtgctcctccctgtcctccagcaagcctgatctggggccactccctcttcctctctgggcctgtttccctccccagaaattgatgagatgggccatgcactctaggcacctttgcagttgacaacgaaaagttcttggaattgttcaggccaggggttttcaaacttttttaagtagtggaactcttgtagtaaatggaatctaacacaaaacatgagtgttccgcactcaagccactggggctggggtgggggtaacctggaaccttttctgctcagcaccctcccttggcactctcacagaaaatggcccttggcgaggaattctgcaggccacctggatggggttgacgcttagtaaggtgccattctttgcccaaggtcacccagggaggtggcccagagctaggtgaggacttaggccttggtctgctgagcagggctcttcaccaggtgtgcaccagggctgtgccccaggaggccaggccaggccctgcagctcattctggctcctcagggcccagccacctggtacccatcagagctcccggccaagatcctgtggcaagcactgatcacatctcacccacacaaggcctcctgggaggccagaggccacggaggaggtgagggagggggggcagggagacgcctctgccaggtagcagtaaccagggttccctctcagagttgcctagcaacccgccaccacagccaaggccccggcatgcccaggctcccctggtgcccaagctgggcttctggggcctcacacctcccacaccttcatgcaggcctggtgcagtttccaggatgggacctccctgacttggtgcctcagcgagactatcgggggtgggggcagagggaagggacagggggttacatcccagcccctcctactgtcctgcagaacctgggtgagaggccagcctgctggggcctcagtcaccagggcgaggaggctggtgcaggacaaagagcagggctctggtgttggatccagattccagtcgtggctctgacacccacaagcagttgagctgcatgctttgaacctccagttcctcaaacaggctacctgcctccacccttgtttcccttgagccttccaccaggcagcagccggagggatcctataaataacccagatcacggtccagtcctgcccagaacactcatatgcccccatctcactcagagtaaagaacaaaggccttaccatagcccaccagcccctctgtgacctcctaggctcctctcctgacactgtcctgcttgatccctcccattcttcaaaccttccaggaacctgccaggtaccatcccaccttgcccagatgcccatgtccatctctcagctcaacaaagtctctgttgagatgccacctgcgcaatgagacctatcctgtccgctcttaacagatgttcctctgccttgccgtttcttggctccctaaccctgctctgagtttttctaaaacaattagcactttctaaagtactgtataatttctttatattatgttcattaatttgttatctgggttcccttattttagaatccaagttccatgaagcatttctgtccctttctttttcttaccagaccccatgtgtttggtgtatgccaggcgtttcataaatgtttgttgagtgaatgaatgagagacagcaaaggagggtaacatagtcttgcagggagaattaatgagattggcagagtgacttgcacagaataggggctgctccaaactgagagaacacaggacagaatgggaggcaagcaggggtagagaaggcaggagcatcctgggccacagaaggaagcacagagaggaggaagggcttcggtgagagggaaagtagggctcccagggtgaacaaggcagctgcccaccctggccccctacctgctcgctcctgctgcccgaacagatctgggtaacccagggcttgctgcggccaaggtctctagcagcctggaccatctgagccagaagatgctccaggagcccccaggggaacagaataacctcgtccttgctgatggtgcctcccccatggacagggtctgagctgtttggtggcggcagctcatccatccaacgggacaccctcatctattcccaggacacccttcgcccacgagcagtaatgcattcatctgacaacacaaccccatttatccagcacaccagtcccatttatccagcaagtacaacctcatttgctaacagcactccattcacctgacgggccccctcatttatccagcaggacaccctcatttatcctccaagtcggaggctctccttcctcctgtggtgtggctgtgttctctgatggtgcaacccgcctgatccagcaggacgtcatctctcctacaagtacacttcatcccctgatactgcaacctcatttatctaataatgcagcctcaccttgcctccaagtaccacctcattccttgacagtacaacctcgtttatcttccagctcaacctcatttctcctcccagcacagcttcattccctgatagctcaacctcatccaatcttacttctccagccagagcccagcagatctcagggctggggagtgggggggaaagaggaggggtttggagcaagaagaagggtcccaccatttgctgtccctggcctatggagggctgcctggcactatgactatatccaatcttcccaggcccctggactttgagttctaggttgcatggtccagccagtgctccaccattgccccccacctcctgtttggtccccttgatggctaaagagaatccacaggatggatttttttttcccagctctccagcaaggaaaaaactccacctgattagatttgtagcatttgctggtttctgtggcatgaatattcccatcgtagccaattttaagctggcagcatgatgtcactgagcgcagaactgggaagaagttctccctgatcagctctcacgagccagtgcaagcccactctcacacaccactggcacacactcacataccaaggcgggagaagggcaccacctaccacgtgccagacctaagctaggttcttcagatacatttcttctgtgaattctaaaagccatccaaactgtggattcagttcagttcaggcactcagtcatgccgactctttgcaaccccatgaatcgcagcgcgccaggcctccctgtccatcaccaactcccggaattcactcagactcacatccatcgggtcggtgatgccatccagccatctcatcctgtcattcccttctcctcctgcccccaatccctcccagcatcagagtcctttccaatgagtcaactcttcgcatgaagtggccaaagtattggagtttcagctttagcatcattccttccaaataacacccaggactgagctcctttagaatggactggttggatctctttgcagtccaagggactctcaagagtctttctccaacaccactgtggataggtaatgctattttatgaagtgggggtggagaggggaactaaggctcaagtaggttaaatgactcctgagaccacaaagctgggaagtgatggagctaggtctgggtctcagggctcttgtattccaaagccaaggttcttctcactcacatccctaatgaggtggggaacgctgccctgctacccacctcagtggccatccctgccttgattctcaagcccaagcttcctggctttcatcagagacaggagacccaagtgttacgctgcccacccataacaagccctgtgctaccccctggcctctagtaccgaggggatcccaggactctcccagttcagtcccggatcttgtgtccatccatccaacctaaaaccaggtatggttgcctctccaggttccattgctgtccaaggttctgcctggccctgccctcaggaagctggccccacctacccaatggggatgtgacccagctcctccctttggtgcctcccagagcagagatcacctgtggggctgcatgagtgctctgattccctctgtgactcctgtttcctctctccttccttccttccctcccttcctgcatgaagaaatactgagggctagaattggaatcccagcctcatccatgtgaccttgagcatctcctgtaaaagacagtaactatcccaacatccatgggaaagggagtgaggccgggaagggcatgacatcccacatcttatgatcttatggagtccctatctcaggcccaggagcaacccttgtaccaccctaaatcccccacccacctctgacccaggaacacacctgactcagagagagtcacaaaaccgggggttgggggtggggaatctaggtaaggaggagggtcacttgctctgctgcttggagtactcagtccagacagacttcctgggagaaggagtgacctagatgacctcagggccctgaggccacatgcaaacccttggtactagggtctgcagggaaggaggggtggaagtgcaggcaggagcatcagagccacaggtgttgacaggtgaatggcttggagtcattagtggaacagaagtgggcagccaggggccaggaggaaccaaatagccaaagcaaggcaggaggtcaagagacaggccctggcatcccccacccctgccaccccagagacaacagagcccacacactcagcctggacagcaaacaagccaacagcagaagtcccagctcacccctactcaaagacccagggctcctcatcctccagactgacaatcaagggcctctgatgctctccagcctcgtcacctccattgcttacacccacctggaactccagccaccctggatatctcacatttcctgcctttgcacactgttccctgtgcccttctctctttctctgtgcacctgggtcctgctctatcaaggcgagctttgtggtgtctttcccctctgcaagcccccaaaataactattccctccccatttctactgaaaaaatctacctgtgcactagagtgtaattgtggatgagtctgcctcccaacttgaactttgtgggcaatccttggctcacggtaagtcaatacatagattggaacttcacggtaagtcaatacatagattggaactttcagcagccatgaaccactcaggcctggcaactttgccatttctgttccgccaaacctcaggctgaagttccaggtattggctcctcctcctcctggtttttcctccagttcctggtgcctctgccacctccctactctctgctgactcctccggagacttcaacaagtggagaaggaaagacactacgatttgctgagcattcacacacacgctggcactcaacagtttaagtcttactgagtatctgtaacaaacctctgagttagtttattattctgattttacagaggagaaactgaggcttcagggaacaattgacctgctccagggataagtgttgcggcaggaattcacaccagggtctgtgctcttccgcctaccctgagacacctctaggcgagcctaggccagacagaaactctcctggggaaagggtgccaggaactgccacgctggctcagcaacccctgcacagatctcctctctcttccaggattaaaggggatccccagttgccaagccattcaggcccctccgagcccctcctcattctgatcccctccctcactctgctggcagcacctcccacacccctgccccaggccttgggagcagctgcagtgacctcacccggccctgccctgagcccagctctggggagggcttagcagctgtgccccagccctgcaggcggctggggggcagggggtggaaaggaagagtgggcatggtgccaagagaaccatctgctctcccaggggcatggccacccgcacagacactggcctcacccccaggggctgcccttggccctctgtccccatgccaaggggctccaggaggcctgagcagcccacccagactggggcagcagccctcatctgccatctgtcttctcccggagcctgagaggtccttgcagggcacattggagcatgaatgtccgctggaaaatgaacaagtgcttggggtaagttctagggggcagaggccagaggccagggctgggtgtgctgagcgctgcccgcccagccccagtcttgtcaagccaagagcaggcaatcccctgggggatgagggcctccatcccctcacatctgctcagctggcaggtgccgctggcagagggcaagccccttcccccacagccccagctcaggttacaaaaggaggcaaggccagctgaggacagggggaggggacaggaggggtggaggaggcctcacagcttcccagggtattgggggaggggagcttggatccctagatgggacttagagccagagagggaaggaccatgcccaaggtcacacagcctgccagtgggcaaagaggagccagcatctaggggcaggcagtgctgagttcaagggtaaccttgggtaaatcactgccctcatttgtaaaagcacagggcctgaaacctgcctgcttgccctcaaggcctcagggaaagctctgtaggctagagagcagcatatggaacctcctgattccctcacaccccagggacagaaagggagggactagaagaagtcttgcccccacccccaacacacacaagtcagtgtctctcagggatcagggcccaggacccccaccctacccagggcatagacagtcatctcctttcctttgccagagcgatgaacaacaataacagtatttgctcagatttcactggggactttacatttaactctcctcagatgtaattctcacagcaaagtttggacatgtcttatcatctcattttgcagaaggggaaactgaggcttggatgctcaaggctacacagggtgagtggcaaaactaggactgctcctccctgcttgcctcaagactcttacccgcactctgtcttacctctgagatcctcgacgcaccaaagggtgctgcctggcacttcaggcctgggatcttggggcctctactctttctcagattcatcttctatcctggatcgcagtatgaagtccacagtggcccctgagccagtctcttcccctgccccaaccctccataccatcctttctgcccatgtcatccctcatcccccacagcttggagtgccaacttcttggtgtggcattcaaggccactcactcaccagccagcccctgcttgcttctccagcctcaagtgctgctgggctctggctaacatagctagaccctgtgaggctcccaaagaatcctgactgagggtttaacttttttgcctcattctcttccctcacctacaaatacccacagcgaattatctgtccctccatcatgaccctgggtcatttttatcctcatcttatttccccagctggacctgcaggcattttgagggcacagagccagtccagttcctctgagcagcgctgcacagtgggtgcccagtgggtgtaggcctggattaaagtgagtggaggaagcagccatcagccccggggcctgcagatggagagggggccgatgtcagctccctccctctgggagctctgggttgcagaaagggagtcaggatcccagagccaacccccaggctggaagcctcagggccaaactccaagggaaatcagagagacaatgttgcgggtggaggccagcctgcactagcctggacagagcactgggttagggaggaatggcccatgggagtttcatctctgtcactgccagtgggatactatgagagcctactttgtgtctctcagcctcactttcctcatttgcaaactggggacagtagcggtaccagcttcacagtttgctatgaaaattaaatgggagcacgcctgtcacggcccatggtggctgcatctccagctggaagagttctgtgtgtggctgaagcaaaggtcagaagacagggctgagtgatgtggctcgagaggttgactggggccaggaggccaagacctggagtggctaaggccccagaactggtccctgtaagaacagcacacgtggtctcacctcccccaccagacagggagctagcagagagcagggactgcgactttccggttcctcacgggccagcgccaaagaggtctgccgaggattcacgccatgaccgttcccctccctcctgcagccaaacgctctgtggcggagcacaggagacacggagggcagaaggcgggtgaatggattctggggggtggggggtggtgggagtggtttcagtcccttgaagctgactgcatggggctcaactcctggaggacccagaaagagtgaggaagagaggtgtgggctcaatctgggcagcctgcttggaggagaaggtggtccaccctgggaacagaagacaggagggacaagcaggagtcaaggaagataccatcgaaggcatcagttcagaatctgacctgtcaccagacggacctgttaaaatacagatttcaaagctcacccgctgacagtctgataagagggtctgagacggggctgcagactgtactataaaagcttgtaggtgactcagatcaccagccagctctgccaacacctaaggacttaaggcaggattctcagaaagacacattgggtttcagaatcacctagtaggtaggtttttgttcaaactacccaagcacctgcctagtttctgaagggtgtccccagggatcagcccctgagagtcgacagcagtcttggcgagcagttgacaatggcagtggtctgggttggcaactccagtgtcaggtataaagatggcagtgtgagggcagtgtgggatcgatcagaggcagcaggggcaaacaggagagagggcggggcctggacacggccagcagagggcccaggggcccgatcagagcagtttgggcttggttggctcccaagggaactgagtagccctggagggttctggagtgagcatgagtgagccctggggcaggaggactcattgggatgtgggctgacactgcaccggcattgggagatggtgacacatggtagaaacagacaggtctgcatctgaacccaggctcagcctcgtttcagctgtgctgccttggcaagagacttgccttagaagagacttcgtcttttcctcaatttcctcagctgcaaaatggggctattatcacatacctggcaggacccagggaggatgaaatgggaagatttatgtgaagtgcccaactgactgcctagcacccgggagttaattctcttaattcttgttccccttcccacaagaggcacccctcttagagaccagaaaggtttctctgcaaagacggaggccctgggtggggggagggcccgctctnnnnnnnnnnnnnnnnnnnnnnnnnnnnnnnnnnnnnnnnnnnnnnnnnncctcccccacaagccacctggcccccctcccacctccacatatgggttggggggtggggagaggcagcaaacagccaaaccctcccaaacaggagttggtttccatggtaacgagggtaccaggaggaaggggggcgctccagatccagctgtcccccctgagcgccctacccgggccccagagcctctgctgatgcccacctaacaccctggacccccatctgcctgctctggggggacagctgggaccgccacgagcactcccttcactgtgctcagagtacgtctgccacctgggtaccgccaggggcagggtaggcagccccaagcaggagcccccagttcaagtccatccacactgctactcactgcgtccagccacgagaagccccatcagtactctgcgcccccaggcccaactacccatcatggctcttagaacgagagggtttatccagttacagctcccaaaagggccagagactgggtgagttaaggccctttggctatggatgagaacacagaggaccagaacaggagagagctttgctccagttcaacacactcgagatgacggtcctctacaggggctgtccccacccctcacccactcccaactccacagctccaacagaccctgaggggctgagctagggcacctggcacaatgctccagagagatgggccatggccagagagaaggaagaaaggcctaaccacccaaaggcctgtctagtgacagaatgggcagtgctggaggctgcaagctcccagcacctcggagtgtgtgagaaagggagtaatctaggaaggagccttgacagcaggtgatgggctccatgactccccaactctcctggagacggaagtcagacttggacgtgataggaggaggcaccaacgtgaacctgtttctcggggacacatccacaagatggtaggcaggccacaggctcagatagggaaggggtgctgaggagtcagctgcgaggtaagggagacagtggcggcggggcgggggcggggggcggggctctccctgctacagccataccctagaagccctcaccgaagccttcgactacacctgcactcctcacaagacacagaggggcttccaaagctctttggaccccatttagcggccaccaccagccaccactcaaaagataagagaaggtgggctgctagaaacaagcttgccccctttccaatccctccccaccccagccctaatggcacaggaggaaacacatgagtttggggtgtataagggggttcagttctcaggtctgccagttcttagggaggtgatcctaagacaagtcttctccacctgggaaagtgggatgctaataccagcctggaccggtgggcgcttgctccccagccctctgagcccttccccttctctggcagagcccctccactccactcagttctgaagctgggttctcagggcctgcagacaggggagccccaacccgcagaaagtgggggctggggggggcactgaactttcgaacctgcacacccccctccccgcgccgttcattaccttaacaggagttaaaaataaccgtctcatctctttaaattagtctgtctgcaattaccgcctggcacggcgctgcccgccatcgtcccgctggagcggcgccaggtggcaggcgggggccctcaccctgtctgtcagtctgtctgtctgcctccgggtccgcccctccttctcccctcagaggtgcagctaccccaggggcctcctggcggccctgcctctcgagctccccaagttgctggggaggggcggcccggggggccacgcacacggctggcagaactgagggggccttcgttgaacagaggactgggaggggatgggggcgggggcgggggggcgcggtagcgggggaggggcgccgggaggcccgggaagccggaagggcccgccgcgcgccagcgctcgtgggtgggtgtgagcaggtggccgtgggagtctgccgggcgtgccagcaactgtgccaggagcggctggcacgggctcgtgcccaggaggcgggcagctgccagccccccgctcgtgcagcgcggggggtgaggacaccccccaacccgggctcacaccgcctcctcccacacccccaccagccctcggggctggggatccccggaggacaaaggaggaggagggagccctgctggaacgggctgcggggaggagagaagggggagctctgcaagcaaaccactgctcagccgggctgtcgcaggaccctcctcctggcctcagggagcagcccctcccttctataccccaccccacctaggacctactggccagcctgggcgggatggggggtagggcaccacccctcctgatcccaccccacaacagccaagctgctccaggcactgagggagaagggaagtccccctccacggggctcctccccacccatcctggggacagcaatgggaggcacccaggtctggcctgaaagctcccaggggagctggcagccaggaaacacaaaagcaggcagaacaactccaggggtgctaagtggaaggagcaccaagatccagagtagcctggaaggcttcctggaggagtccagcactagggaaggaggggctagagtgtcagaggaagtgggagaccctacttggatggtaagggacagggaggcctggcacgctacagtccatgggggtagcaaagagtggacatgacttagcgactgaacaacaataacaacctggatgtgggacagccacacttccggaccctgtagagggagggagacttcctgtccaagccctcggccccggacctggagaccctatgccctgatggcaactcttccagcctctccggcaccaagcccagtctctcttcgggcttcagcctgctgggtgccttgcgcctgctgatgatcttgcctcctccaattcctctctgcaacacctctgaactgtcatcccacatccctggttgggccacagggcaaaagtcaagcccttcctgatctggcccactcggcctttcccatgacacagccctgccccctccaggagcccttagttccagcctggcacgcccaacagtctcccaaacccagcgtatgaattccacctccctgtctttgcatacacagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttggaagtctttcccccaattctacccgccttccccacccagtgaagacagaccagactgccacccagtgaagacagaccagatagagtgccatattctctgggagggcttgcctggctccccaggggatctccctgctttcaccacacccctgtcccccagccctgtcccccccagtccccaccccccagcccttcctgcctgtaaaacgcagggcttgggtagccgtgatgcatcctgaaggtaggtccaatgcctcccccactggtccccccactctatctatcacagggttcagtacacggcaggggctgaagggcaacacttatgtgggggaggggagggaagaaggaacaatgggtccctggccccaaccctggcacctgaggtgtcccataggctctgtaaccagagggtggctgggagttgggaatggcccctccacccagcccctggagggactgactgggaatgggggaacaggtggtgggaggggcgggaatgagaggggaaagaggctccctggggagctggatgcaggtgggatagaaggaggacagccattgaggggatgagacgggaaaggccagaggtctttctgaacagccctcctccgctgctgcgggggtctctgccagggtctaggtgaggagcccaagcctgaggacccctcaccaatgccccagcccagggcaagccttcctgagcccaggcacagggagaagcagtgtgtccccagcagtgtggtgcagaggaacccgcatccaacgggcaggcgggaggcctgggccatcatccagggcctgccgctcactgatgacctaagaagagtcccattccctgccagggcctcagtctaacagtctgcaaaatgaactcatgggactatattatctccaagtaccttcccaatcccattctcagatttagatccatccctgtttgaaagttgccagtgtccccctgccacacccagggcaagcaggacactattccagaggctctgggtccctggagggagacacacagagattggaatccagctttcccatctactgactgtgaccttgggcagtttgcttctccactctgtgcctcagggcccagttctgtaagtagtgacagtaaaacccacctcaggcagtgcagagggcattaaaggtgacacctggcgcagatgcctaaagctgcctggcagagggcttggccctgagaccctcagtgcactgtagttttttcccaggttcaagcctcatgttccctcttgccatcttccccatcatccctaacccttcaactccaattggagctccgcctcctgcaggaagccctcctggcttgctctgactcacagtatcctccctggtctcagcaccctctgcactatccactcactcctttactcttttaccagacatgcactggtagctcctggtgccaggctctatgcttggtgccatgggcacagagattgatctaaccactgccactgttttccaaagagggtggggaagggaaatgagacaggacacaaaagactaagacttatgacaggtagggagaggacctgagctagcgaaaaggggttaggaaaggcttcctggaagaggtgtctgaactctgcccttgaggacaggaattatccacaaggagaagcggagggtgggacagtgcaggggagggaggtgggagcaaagcacaggacccacttaggaggaacaagtgttctgctgggggctgagcccagggggaccagctagaggatggagagaaagactcaggcctgctactccagcctgcgtccccaccccgtagtggccagagagacagaggagctgccagcataaaggctgagagccatgggctcccaggtcaactcccaggtcaacacagccaccgggcatctcgtgctgttcatgtccacaagcctcccctcctccactggcacacctccttcccctgacactgcctaccaccaccagccacagcccttgccctccatttaggcatgtctccctcatagagaccccctcttccacagggagcctgacagcttacaggccctaggcatggcctgaccacccctaccccccagcctcctctcctccaaaggcattgactatatccattccccaacaagttagccaggggaggatctggaggccacaatccagtcaagaccccgtcctctcccaagatggctcccccctttccagtggttggtactgaggcctccctggggtgcccctcccccttcccccacccccaaatgcatctgggctcagaaaatcagggaagtgggagacagacagcctggggtgggcacagacagatccccaggtctcaacaccctgccctcacaccagcaggggtcatcaccagcccaccatgctgatccaggcaagggggggacagcagctgccccatggagaactcagatcacctgaccagttccccaccttagactggctggtgccctagggtgaactcctggcactacagaaagaactgtgggcctagggtcgcattcctcaccctgaggccagcttcagggagggcagtgggaaagatttgggaggaaagcagccaccggcccggtcattatttcagctctttaaggagggtgccctggtggagagggtaaaacaagagtaacagaaagcaaactcgggaggtaacagaggggtccccagtgtctgaggcctgagaataggctcttctgctatgcccccaaggatggggtgagggtatccctcgggggtgcctcaaagtggcagtcccttgtcaccctaccagacctcccaccctgcatccagagcatgcacacagctgctcccagcacgcccccgcctgtctgccggccggccccacgccctgggcacacactctgtgacccctgggggtgccccagggtttccctccagaccaactaccgggtgcccagggacatctagcagcccttggaagccccagccaacggctctagcacccctcccagccggacgcccccaccttccagccggccgagctgttgctgtcgcctttatccttgaagtagggcacgtaacggaccatccagtcgtagatctgcgagagcgtgagccgcttgtccggggcgctctcgatggctttggtgatgaggtcggcgtaggacaggttcccccacgcgttccgccgagagctcttcgctttccgcagcggtccgacctccgcgcccagcggcggcgctggggccatcggcggggccgtggcccggcgctccggcccgcagtcctcggcgctctcggccacccccgaacccagcgctccgtcctcgtcgccgaccaagtcgggctgcggcaggggccaggtacacgagcgcggccggctctgcggcgcgaagtccgggtccacgtccacctgatgcgctcgcagcttcgcagccatggtcccgcccggcttgggcgaggaggggaggggggctccgcggagggtgggcgggcggctccgggatctgcgcgccccggggaggcccgcgggaggggtccctggcggcgccggctcaaccgcggggcgccatgggccaggtcgcggagacagggggctggacgcgctgaaaagcccgaagggaggaaaagaggggggcagtgagagagcggcggccccggagcccaacgggcacacacctcgccagccccgcttctagcacctgccgcctgcttgtgcctgcagccaccannnnnnnnnnnnnnnnnnnnnnnnnnnnnnnnnnnnnnnnnnnnnnnnnncctgcgggctggaggcggaggcgcggggctcccggccgggggcgaccccgccgcagcccctgcatgcaacagcgccgcctacggagcagggaagacaaggcaggcgcgaccccgccccctgctttgctctaggggagggggcgcgggggcggggcccgggcactctcattggtccgaagcagggctgtcccgcccacggactcggctggatccctcccctgagcgcgtcagcgggttattgttacaacccggggtttcccggggcaacagggatgaggcggggctcagagcacatggccccgccttctattcccgggaggaatgccccgccctctgtttctagacccttggtatttccaaatcttcgttccagaaacctggtggggtggatgatggagttcttctgttctttgtgccccgggctggggaaaaggagagggtcaagaacacctgggttctgggtcaggcttggccacaattttggcttctccatctgcaagttgtttttcgtaggcattcagagtgcctggtttaacgtgtagtagaatcaacctggagagcttgttgaaacgttttactgggccccagccagattactgggttgcggcttgagactttgcatttctgacaaggtcccaggtgatgcacccgggaccacactttgcaaaccactcttttagagtctgttgcaggctgttgccagggttgttggaacaaacacttgcctcaaatttcatcctgtttggggagaagtttctcgttcacttactatatttattgagcacctttgatgcatgtgcactgttccagctactaaggcgagagcagcaatggagacagatgaggtctctacagcataggctgtgaagaagtcaggtgttgtcagatcactgtatggcctcagtagtagagaggccagccgagcaattgggcagcccat

SEQ ID NO: 2 - DNA, 54567 bp, Bos taurus
  unsure (10433)..(10484): sequence unknown
  misc_feature (10434)..(10483): n is a, c, g, or t
  unsure (23417)..(23468): sequence unknown
  misc_feature (23418)..(23467): n is a, c, g, or t
  unsure (47035)..(47086): sequence unknown
  misc_feature (47036)..(47085): n is a, c, g, or t
atggatcctgaacaaagtgtcaagggcaccaagaaggctgagggaagtccccggaagcggctgaccaaaggagaggccattcagaccagtgtctcatctagcgccccgtatcctggcagcagcacagccgccactcaagagggccccctccaagagctactagccccgcagcccttcccaggcccctcgtcggttcttagggaaggctctcaggagaaaactggtcagccacagaagccccccaagaggtcctccatcgaagcctcagtccacatctcccagcttccgcagcaccctctgacaccagcattcatgtcgcctggcaaacccgagcatctcctggagggatccacatggcagctggtcgacccaatgagacctggaccctcaggctcttttgtgacccctgggctccatcctcaaagccagctcctctcttcccatgcttccatcattcctcccgaggacctgcccggcatccccaaagtctttgtgtcccgtccctcccaggtctccttgaagcccacggaagaggcacacaagaaggagaggaaaccacagaagcccggcaagtacatatgtcaatactgcagccgcccctgtgccaagcccagtgtgctccagaaacacatccgctcacacacaggcgagaggccctacccctgcggcccctgtggcttctccttcaagaccaagagtaacctctacaagcacaggaagtcccatgctcaccgtatcaaagccggcctggcctcgggaatgggtggcgagatgtatcccccagggctggagatggagaggatccctggggaagaatttgaggagcccaccgagggagaaagcacagattcggaagaggagacgggcaccacttccacacaccccacagagctctccccgaggcccaaacacccactcctgtccagcagtttatacagctccgggagccagggttccagccacgaacgctgttccttgtcccagtccagctcggccccgtcgctcgaggacccagctccctttgcggaaccctcatccgaacaccccctgagccataaacctgaagacacccacacgataaagcagaagctggccctccgcttgagcgagaggaagaaggtgatcgacgagcaggcgttcctgagcccgggcagcaaaggcagcaccgaatctgggtatttctcacgctctgagagcgctgaacagcaggtcagccccccaaacaccaacgccaggtcctatgccgagatcatcttcggcaagtgtgggaggatcgggcagcggactgccatgctgacggccacttccacccagcccctcctgcccctgtccaccgaagacaagcccagcctggtacctctgtccgtgccccggacgcaggtgattgagcatatcaccaaactcatcaccatcaatgaggccgtggtggacaccagcgagatagacagcgtgaagcccaggaggagctcactgtcgcggcggagcagcatggagtcacccaaatccagcctctaccgggagccactgtcctcccatagtgagaaagcgaagcccgaacaatcactgctgagcctccagcgcccgcccagcaccaccccccctgtgcctctgctgagaagccactcaatgccttctgccacctgcaccctcagtaccccccaccacaccttccgaggcagctactccttcgacgaccacgtcgccgactcggaagccctgagccgcagcagtcaactgtttacctcccacccccggatgctcaagcgccagccggccatcgaactgcctttgggcggagagtacagttctgaggaggcagggcccagcagcaaagacgcagcctccaagcctgcagatgaaccggaacccagggaaagcgacctcaccaaaaagaccaagaagggtttgaaaacgaaaggggtgatctatgaatgtaacatatgtggtgctcggtacaagaaaagggacaactatgaggcccataaaaagtactactgctcagagcttcagttggcaaagccagtcaccgtgggtgctcatgtatcttcggaggccgagaagagccaggccgagcatgagccctggtcccagatgatgcattacaaactggggaccaccttggaactcactccactgaggaaaaggaggaaagagaagagccttggggatgaggaggagccgcccagctttgagtccaccaagagtcagttcggcagccctgggccttcagaggctgctcggaaccttcccttggagtccagcaagtcaccagcagagccgaataagtcagtgccctccctggagggatccgcaggcttccagccaaggactcctaagccagggtccagttcagaatcagggaaggagaggagaaccacgtccaaagaaatttctgtcatccagcacaccagctcctttgagaaatctgactctctggagcagcccggcagtttggaaggggaagacaagtctgcggcccccttctcatcacccccgcctgccccgcacggacgctcggcccactccctgcagcccaggttggtccgccagcccaatattcaggttcccgaaatcctggtgaccgaggagcccgaccggccagatacagagccggagccaccccctaaggagccagagaagacagaggagttccagtggccccagcgcagccagacacttgcccagctcccagctgaaaagctgccacccaagaagaaaagactgcgcctggcagagatggcccagtcatcgggggagtccagctttgagtcctccgtgcctctgtctcgcagcccgagccaggagagcagtgtctcactgagtgggtccagccgctctgcctcctttgagagagatgaccacggaaaagccgaagccaccgggccttcatcagacacacgctccaaacccttgggcacccacatgctgaccgtccccagccaccacccgcatgcccgtgagatgcggaggtcagcctcagaacagagccccaacatctcccactccacccatatgaccgagacacgcagcaaatcctttgactatggcagcttgtccttgacaggcccttcagcaccaactccagcagctccagtggcctcagcagccccaccagagagaagaaaatgctttttggtgagacaggcttctctgaccaggcctcctgaaaccgagccagaagccacccccaagggaagacaggagagtgaggaaccaaaaccctcatccagtaaatctttggccaaaggcgcattgctcccagtttcctctgcagccacctcacacagcgggcacccaggaggcaagagccaggtgcaagacagaccagcgctgggggccactccgccctacacagaagcactgcaggtgttcccccaccccatcgctcagctcccgttgcaggagaaaccctacctgcccccgcctgtctcccttttctccttccagcacctcctacagcatgagccaggacagtcttcagagttcttccccacccaggccatgtccagcctgctctccacaccttactccatgccgccccttcctccctccttatttcaagctcccccacttcctctccaacctactgttctacacccgggccaactccacctcccccagctcatgcctcacccagccaacatcccattccgacaacccccttcatttctccccatgccttaccctgcctcctcagcactttcttctgggtttttcctgcctctgcaatcgcagttcacccttcagctccccagtgaagtggaaagccacgtgccccagatcaaaactagcctggccacactggcaacaggaacccctggcctctcccccagcacagagtacagcagtgacatccagctgcccactgtggctcccccatccagctgctcagcacccacatcagcccctccactggccctgcctgcctgtccagacaccatggtgtctctagttgtgcccgtccgcatccagaccaacatgccatcctatgggagtgccatgtacaccactctctcccagatcttggttacccaatcccaaggcagctcagcaactgtggctcttcccaagttcgaagagccctcatgcaaagggacgtctgtgtgtgggacagatgcgtatgaggtcgggcccagactggctggagtaagtgaagaacagagcagaggtttcccgactccattcttgagagtgcctgtgacattacctgaaagaaaaggcacttccctggcatcagaaagtgtcttgagcctggaggggagttcatcaacagtgggaggaagcaaacgtgtcctttcaccagctggcagccttgaacttaccatggaaacccagcagcaaaaaagggtgaaggaagaggaggcatctaaggtggatgaaaaatttgaacttgtaaaaccatgtagcgtggtgcttagcagcaccgaggatagcaagagatcggagaagtcctacttgggcagtcagggccagggcaggagggaactagaaacactctccagcctgtcctcagatccatctgacccaaaggaaattcctccccttcctcagccctcattgccccatgtgacaacctcaggatcagaggctttgaaggaatatgcccaaccatctggtaaacctcaccgaagaggattactcccatcaagtgtgaagaaagaagattccaaggaacaagctgacctccctccactggcacctcccagctcacaatctctgtcagaaacatcccccagaccagccaagttgcaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccaggggtttccactaaagctgctttgtccctcctgaggtctaagcagaaggtgagcaaagagacatacaccatggccacagctccacatcctgagacaggaaggcttgtgccatccagctcccgcaagccccgcatgacagaggtgagttcagtcttgtttttcttctactccctgattgtaaaagcctttgctgagcttttaaagccacattctcctcaaggtccatttgcaaaacgagagccaactgagtggacagatttcctctctatcagctgtgactggccaccttatttattggatttctttgtcagtgtccctcaaatcattggactagatgcatttcaataaagtgaactttaaagtgacccactttcccattagcttctattgaaatatcaaagaaacaatcttatccaaaagactgagttcgtaaaccttgctgatgggaatgcctgcaacagtttgagaattttatgccactccaacatatatttcttccttacagtgttagtcttttcctgcttttcgtattctctgcatctactatttctgttctctggtgccacttgagattttctcagagagtctagagtttgacaaaaaagactcctgaaatattccttttttcttttatgtgagtagaagagcaaatagaccttaactgtagtatccctctttaccggtaggtgacagttccacagcttgactcatctttgctgatggtagtgcacaacgctggcaatgctcatgttttctcctccattgcctctgacctgaggctgcattaggaggcatgaaatcttgatctctgcaagttcaggaagattgacatttgataattccaagtttgtttcggactggtgacacctccatatcctggtgtcaccttgtcaggtgacaagggcagcgtaaggattcaagtcatgatgtgctatgctgacttgatatttgtggaataacagttggtcttattggttgagtagcctcactgtgccaggcattgttctgggcacttgaatccagttgatgttcatcactgcctgtgaggtagcagtaccatttccattctgtagatgaggaaactgagagtcagaaggtgagaggtccagagcacatggcaactatttggcaaacccagaatttggaccaagacctgtctgactccagagagtctattttcttctttcaattattcaaggaaagaagactgtaaaagtgactgcaaatttaaagatcttcattagtaagtctttagaacagatcctttgaccaaataaatccccctaaactaaatcctgattgcagataaatgaacaaactatgttcattaacttctgcatttgcatcctcttttactgagtgatgcttgtgcattgaatttctccttagctcgcctggatattctgcaccaaactgtttcccaaatttattctctaaatatccttgtcagtctactgctgctgctgctgctgctgctaagtcgcttcagttgtgtctgactctgtgcgaccccatagacagcagcccaacaggttcccccgtccctgggattctccaggcaagaatactggagtgggttgccatttccttctccaatgcatgaaagtgaaaagtgaaagtgaagttgctcagttgtgtccgactcttagcaaccccatggactgcagcctaccaggctcctccgtcggtgggactttccaggcaagaacactggagtgggttgtcattgccttctccgttgtcagtctacagacatccttaaatgagatttccactattgttatacacatcacgactgattttctctccagtgtctcttactggttgtggctactcctgagatgctgtggtaattatagtcatactgagaacttattgtgcacctattatgtaccaagtactatgcccaacatgacttttttcctcacaaccacattgataggtttctatatcatgatttgatggataaagagaccaaagcataaagaagtcaggtaacttgcacaaggtcccaaacatagtaaatggcctggattcaaaactagatctcactctaaagttcttttggatgatctgaactgcccctctgtttcaatgactgaacactgaaaggtggtttaagaaaaacaaagaattaatttggcttaactgggtttgacaacaagttgtttaaaatgctgctttcctaaaatgagctgcaactttttcctggaatatctcatttggttcacttggatcagctgataaagaatccgcctgcaatgcaggaaacctgggttcaatccctgggttgggaagatcccctggagaagggaatggcaacccactccagtattctggcctggagaattccatggacggtatagtccatggggtcgcaaagagtcagacacgactgaagactttcacttaaacacttaaacttagcgtgtttcctaccagaagctcaccagtctgatacattactgtaactgcatagcccactgcttgatgcctttctacaatcatccctctctctggtctctgcttgcattccagtgataggttgctcaccaccccttagtacaacccaacccatctttgggcagtgctttaagaaagttccctattatattgacctgacatttgtcatcccatagcttccattaactgttagtagctctgaaaaggccctttgggtgatatcaggatttcaaagctcttcctaaccatctttatacaggaatagaccacccagtcaggtttgagtttggtcacatacattttttttttttttcatatgtaaaccatggggaaacccaagcttatacaagagttcactttgcagccacatttcgttccccaagtttctccttcctttttcctccttggcaataattttgacaaccgcatgcactattgcaaagagattaagaacaagggcttcagtgccagattgcccaaatttgagttccccgatctcacttactaattgactttggatcagttacttaacctctctgtgccttggtttcctcattggtaagacagagataaaaagctgtaagatagaaaatacgtagctcataggaatgtggagataattatatgagttaaaatatgcaaggtgtgattagaacagtggttggcacactgacacttgataatcactatcttcagttactcacattattatctttaaaacttaaagtgtatccctggtcccctgctcgagtccaaccatgtttcctggtagagtgtctgctgccaccaacaccagcctcctccagcttggctctgacatcacagctatcagcctgagggaggcctcttggtcattccatggatggcccagatggtaggctgacatggaagtgaaaacagcatgctctgaaaacctttgagtattgcataaaatcatcgatcttttgctgaagcggcacaccataccttctcttggtttccactccccatctccaattcagaagagattgtcagtgagtcactgaatcactaaagctgatcctggaatgaatctttaagatggtctaatcttgactctgagcctcagagaggtgaattaatccacccaaggttggctcagtttgcagtggcctatgtgatgcaagaactcagattccttgatttccaatcagctacttttctgttcagccccttgtaggagcaggtgtggtggctgaagcagggatttctgtccttagattgtcgcagcaccaggggacacagttgctgctcctactggctataaacagggcagttcctcctgaccttaatgaaatggcatgaagcaggatgagaatatcactgccagcctcagcccccagcccagcatcactgctctctattaaaggtgcacccatccctgccaccatcagaggatctaggggacaggttatccacccagctcttaacaccaaggcctatagctcatgaagagaatgggttccctaaaatgcccacccccccagacacatgcccatcagtgggcagcacagcctctctgtgtccagctctggcagcagtcgggggtggggtcagggccttcaggagacctgctttatgctcctagaaatgcccttgacttgctgtgtggctttgacttcctgatgtataaaggagaattgggccagttaatcttcaaaggtgaagtcttcatttctgtatgcagcattcctctcacacaccttctctgaggttggcatgacccaggagaccaagatgaggacctgtccccagaagcccctagactagtgtgaaaaaagagaagaaacacagctctcgtgggaaggcctggtcttccctagagaaaggcctgggcagagtcctggttctgacttcacctctggggattcatttcccttcttctgtaaagtggggcaggtagcatcttgtctccgggtagagggagaatgaatgaagtgagccatggtgaagcgtgggcatcattccatgacggcgtgttaaccagcagtgattttgttgttcctgcggtgggccaggttcgcctcccttcgctggtttccccggaaggacagaaagagatagctagagtggagaaagaagaggagaagagagggaagccggaggaggacgctcccgcctccaagagaggggagccggcgaggatcaaaatcttcgaaggagggtaagaattatgtttggtttgcagtgtctgctctccacgcagtaagcgctcgtgcccgcccgcaggctgggggtggtgcctgccttctgtgttcagaacggtgatctgtgttcagaggtggtgagcatctcatctggcaaggctgtgtccacaggagccctgggctttccaccttccaggaagtgccatctttgtgggacttgctggccacctctgttaaggaacattggctccttggtgggggctgggggacaccaggtatatgctgggcactggaacagtctgggtcttcccccagcccctcttgcctcagatgctggctgggttcctagaccccacattggggttgatagtgaccctcccgggtcctatgcggactgccgtctacgttggtacatgttctgcagaagtcacctctgtcctgcctaagcagccacagtgacaggtctgaggtcccatgggctctgccaactgggatgcttacagggctgatggtgcactgcactcatcagctgtacatactggtctctgggtctcttcctggactggcctgatccaggacttgttgatttgtaaacatttagaggaacgcccctggtttttcaccttcggtgctttgtgtttgtcaacctaatgactgaaacagctcagaattctcagctgtggggctctcggggctcccagaaggctgcctgcttccaggcctgctctgtggaagtgtcatgcgagctgtgttctgtgtgaccacgtgcgtgctccctgggatgtgggtgtctgtacgcaggtcccgtggtgtctgtctcagggtcctgtgtctgtgtccccagtgtaatcaatgcagccctcttcctacccagtcctgagggatnnnnnnnnnnnnnnnnnnnnnnnnnnnnnnnnnnnnnnnnnnnnnnnnnnctccagcacttgcaagtgcccagttcacaagatcaaagtgggaggtgccaggttcctctggagcactgggagaggagacagtgcccagctcccgaggccactggtgggcatccttcggcactgaccaacagggtctcccaggagaaggggtgtttgaaaactgaacttggggacttgtgttgtcacagcaatagggaggggagtcagggatggcaagcatccttcagtggcaaggacacgtccccaaaggggagaaatatcttgcccagagttcccgtaacttctccattgagaaacactagaccagcgggttttcgaaacactgtctttccacctggggactggcgggtttcctcttctgctacttggttagagcgcccccgtgtgtctctgtgttcgcacatcatcggatcctccaaaggccatgtaacatttcaccccaggattggtggatcaggcacagccttctccctgcagcttcaaggaccatctgtggggtcccaggggtggctgaatgtcagctggtgtgaacaaaggggtctgcctctgccttgagaggcaacagtccccagactggagatctggttccctgaggcagttcccttgttctgagccccgaaagggcagctggaaggagcctttccccagcccagttagttaacagctccagcccctcctagagtgagaggtgaaggccacgtctgggtcctcttctcctctttctgcagtctggccaggggtccccactctaacccacccccaccattccatccaggtcatcacttagtcccacccactctgttcagaatctccctgtcttgccaggtccagcatccctgccccagagtggctctcccactaacctgttccactgggacagtctcctcacctctccagctctgcctcccatcggtaaaaggggtaattacatacttggtgggttgttgggggatcttgtgctgccctatgtaaagaccagctcagttcatggtgctaacaaatgggtattggagtacttttttcatttttgtgtccattgttttgatcccctccaggataatctcactctgtcgactgtgaggaacatcaccctcactctctccacttgtcacatttaatttcagcactttggtagggggaacggtaatgccaccagtcaggtcatcttctcccacagtcccgctgtcccatctgggcccctactgtacctactgtacctcccaccttcgcttctggtgacccctcaatatttatggttctttgggggctggtgtcaccctccaggagagtttgcaaatgtggacttgaaagtttagggttgtcacagaacttccaagtgctctgtaccagaagatagccagagccaggagggtcaactgtgatcctgctctcatggaggctggctcaggggtagcagaaggcctggagctgaaatgtggggacccctgggcccagagtagccagagagggcttcctggaggaggtgggctgggcctggagggtatatgagacccggacaggcagagaggaaaggtgagtcagacggcagtctgggtgtcctggtgactcatgcacctggtcagtcggactcgtttcctgtggccttgaacggtctccctagtcagtgttgtccgcttccttggctaaacttcatccctgcaccaaggacatgaaatctgaatctccagctaggaccttactcctgaactgtagaccattgcttctgatgcctcatgggcacctctgcctggaagactagggcacctcaaacttagtatgtgctgaccaggctctacaggtaccaccaacagcatctccttccatcttgggaaccagatccttaggctcaaaacagctctgtctcatctccattaacaaatcctgtcaactcaccctgtgaaaccacatccagaagctgcccatttctcccacgtcccagctcaatcctctgctgagtttcatctggatcgtcacagtctcctgctagaatctcctgcttccattttacccactatcatgtactcttaacccagcagccggagcaatcccgtttaacatcagcagaccctgtcactcccactctgcacccttcacagacctccagtagcctgcgtgttctagccccagatcctccctgacctctgcctgcccctctaccccttgcttctcctttttcttttaaataggtcttttaaaaatttttatttatgtatttattgactgagcttggtcgtcacatgagctttcgctggttacagcaagcaggggccacgctctagttgcagtacgtaggcttctccctgtggcagcctcttttgttacggctcacgggctcgagagtgcaggttcagtagttgtggtgcataggcttagttgcctcacagcacgtggagtcttcccagaccagggactgaacctgtgtcccctgcattggcaggttcctaccccttgcttcctgtgctccagccaaggatctctttgtctgacatgttgctaccttagggcctgtgcacttgctgcacgctctgccttgaacacttttttcagagtcccacaggtccctcacttccttcagtcaccttcagagaagccttaccagatcaccctcctctctgtatcctcctccagcatttcttatccagcttcccttccctgctttatttttccccagtcactagtttacttctgtttccccctccagaacatacaccctgtgagaggtcaggaattgtgctttattcattgtcatatccccagtgctgaaaatggtgactggcatgtaggcagcgctggtgaatgtttattaactgaaggaatctccctttacctccctgaactcagcagcccttagaatccatgagcagtggagactctgggtctcaggaaggaggaaggacagagagtcagggccaacccaccaacctgacgtcagacttggcctgggaaggtgaagttgggtggcttcggctatggggcaagcaccctggggctgggagccaaggttgtttgcttgctgacctgccctgcaagtgttacaggtaaaaaacgaaacatgattccaaaaagggctggctcatgggttaccagcttcctggccagtgcctgctctgaatagatcctttctgtcctgggggccagagaggagtggtcctgggcacccaactctggagacaggccgctgtccttcctgggtgagtccaggctatcagggccgtgtcttctttctgactcagtgccttgatccctcttgaatgctcaggcttctccctggagtatagatgtgcagctttgagtgtggccccttgggccaggagcgagaggtcctgcttctgtcacatgttcccacactggctttagttctctttctatttctcccaaaccctgttgttccatctctcctagggaagacctgggcttttgtggacacagaggagggtgggatattgcaaagcacaggtgcgatattcaatggcccagaccagggagatggcagtggagatgggggtggagctagaggacatctggtgaatcgaatacaaagggtagggatgagaagcttggagtggagaatgactgccacgtttctggctcaagggtatatgaagctgccatttacggagatgggcagggatgggaaggagagtgagaaagaggtttggggaaggaggggtcaaagcttggtggacagtgttcagtttgaggtgccagtcagacatccaagtgttcaggaaggcgtgtggcaattggatatctgagcctggccttcagaggacaggaaaggtacatttgagatatgtgtagatattcacatttttcagtgcatagatgctatttaggaggatgcaactggatggtggatcacttggggaaatggaaagaaaagaatagggcatccaggatggggccgggatatgccagaggagaggtagagatgaagctgcaagagtctgagaaggaaaagccaaaagaatagaagagacctggcagaatgagaaatcctggaagacaagggcagagggagttcaaggtcagctgtgctgagggccatttaaaggccaaggacagggaggccaggcaagtgtccgtgggatatggccacatgggggtcactggtgaccttgatgggagctctttggggagatggagttctaaaggtggcgcatgtaaacctgtcccaagagtctggttatggagggaaggagggaatcacaaggaagtgaggagcaggacccggacatatgtgtgtgaggctgagcaggcgatatttacatggagagatcctccctaggcttgtgctgctaggaatgattgacagtaggggtgggtgggggagggcttggcagatgatgatgctgggagagaaggggctgagtgcaggcagagtcctagaggaggtgcaaggtgtggggccaagcactgatgagaagggggtgcttctcctagagtaatggtgcggggtgaggggagacagatgctgacgcactgcaggcagaactgatggtttggatgggggaagcggggagggttctctcagcccccatccagacctcttcttgccgttcctagatacctacattctcaacaacagatctgtgaatggctgttctgtttctaggaaaccacttagattcttgggaaagttattcctttgtaaagattatcctccaaatagatatctcagatgtaaagccatctagttaggtcgactctccatgctggcctagcatcattctactgaacactcagaggacttcatagggaacactcactccaggcattagacaaaactgattatgtcactatgaaacccagtaaacactgtgaaacgacagtaaaaaaaaagaaagaaaagaaaagacatattgatcaaggggcagactgagtgtctgagtctgctgggcccggagtccccagggtcttgaggatggtcagggaagacctaaatgcatcctattaaaatttaaaggagaatccatttctcaagcggatttggcctctggttgctatggggtctaaggcagcaagaggctcagctgagggggtggggctgggaagtggagtccccaccccagtgtgcgatggccgccggcagctgcaatgagcactgggcatcccctgggcctggaccgcatctgcctgagtctccacctgcctcctccctgtcctgggggatccccttctctcctgtgggggaagcggcctcttagcaaacagtggcacacactctccctctttctttcagtttttatttttttatttattttttaaaatgtatttttattcgtgtatttatttgcctgtgccaggtcttagttgtggcatgcgagagcttccgtcgtggcatatgaactcttagttgcgatatgtgggatctcgttccgtgaccagggatcgaacccagaccccctgcactgggagggctgagtcttagccactgtgtttattttatctaaattttacatgcacagagttgaaaaagccaaacatctctataaattttgttatggaagacgatagtacccttctttcccctacattttctgccctgccccacccccaccccagaagcaataactttcatctcttctagctgattatcttggttgaccttcgtatctgtgaataatgtgcctgggttgctactcttgggcttttcagctttaggtgctagctagtgactcacgagcctttccccagtccacacgtgacccctcatcccccatcctctcatcagagtcgtaccatttatgcttcacagctatcttatatgatacttttgctttcctatacaacttttattttctctaggaataaaagttgtatgtgtgttaacttcatcagttttctatatgctgtgctgtgcttagtcgctcagtcatgtccaactttttgcaaatcccatgggctgtagcctgccaggctcctctgttcattctccaggcaagaatactggagtgggttgccatgcctttctccaggggatcttcccaacctggggatcaaacccaggtctcctgcattgcaggcagattcttcaccagctgagctaccaggggagccccagttgtctatatatttattgttaattcaacccccagattctcacttcacaactctcccctgaagacgttcagatgcatcgggtcctctgtaaatcatcttgcagacacagtccctccctgagggatcctgtggactccaggccacacgggctgctccctcagcctggaacacagctgctaccccagggctccctcactctcaccctagagattctcttgcctcctatgcttgattgcctcatagccgtacatcttcccttttcctggtttacttcctcattttcacagagaccatccttcagcatggccttcttgagaaagggcctgtgagaggtgagctttttcgatgctttgcatgagtgaatggattgaagtgtttttattatgttcctcagtcgactcaagtgtctaattctgggttggaagtcattttcctttagagttttgaaagtgttgcttcctcctcctcaagcttctgggttgttctcaagaattccagatccatcctgattcttgttctatcctctgtgactgtctgagggtcttctcttcctgcttagagtggcgacttctcaagcgtgggtctcggtgtggagcagttttcatcactcgctgatgctttcaatctggcaagtcagggacttctgctttaggaaactttcctgaatggtttccttgaggattttctctcctctggttttctctctcctctctgtggtactcctgttattcatgcgctgagtaagtcctggctcgttcctctaatttctatgcctctctgccagaatccccatctcttcgtatttttgctctcctttctggggacctctactttatcttccaaccattcgtgttttccatttctgctatcacatttttaattttccttgcatgttcctcttatattaatagtatcctattctttttttattgagaatatctttatttatgtacttctgttagttaaaatattctctattttttaagttgagtgatttttttaaatttttattggagtataattgatttacggtgttgtgttcgtttctgctgtccagcaaagtgaatcagttatgcgtatacatatatccactcttttttagagtcttttcccatctagggctttacagagtatggagaagagttccctgtgctatacagtaggtccctactagtcatctattttatatatagtcgtgtgcatgtgtcagtcccaagattccaatttatccctcctcccttttgccaccctggtagcaataagtttgttttctacatctgtggccttatttctgtagtgtaaataagttcatttgtaccaagtatcctattcttatttgactgattccaggcctctcggaggctattaatgtcagttgttttgtctttagtgttcttttccccttgatttctgtttccttcaggttcccctcacccttggctttgtttagcctcttctctcaggtatctgataacctctggtgtcttcgcatgttaagagcgggaggctcaaagatgcctgggcacctgagtgtgagagcaaggcttccccgagactaggctgttctactgcggaggctgcagtggcagagtcttgtgtctttcttcttggatgaagactccagcctcccacctgaaggtggcagggttcatttcccataatctgagagccacagaaaggaaaaaggtgggacgcagagcgaagggggatctcagcctccagtgatgctttcactccatcccttcatttgtttgcaattccccatcctgccatcacctggcctgaaccccctcagaggccttccatctcaccctttgcagagaataaacctccaggctttttcaggagtgatctggctgctggagttgaggaaggtgaggtctgactgcttctaacaggactttccactagttgtccttatcttggtcctccccgtatgcacctccagagtccttgaggggccctgtggcataagtggagtttattctcatataacctgctgtcaacttagattccattctgttgggtctgcaaagtcttgttcagccatccgtctctttccagcttccaaaactgcattgccagtaccctctcctgctcttcccttctttgtgtgtttattatgccgagagagagaagcaaggggaaaggaaatataaatactgtttccccaccatctttaataacaggcgactagtagggttgatttttagaatgttttaggcacagaactcattcttccaaatagctcttctgagaaggtcaccctgcagccttccctataggtccttggagcccctgtggcacttccttgaacttctgggctcagaggagaacaggggaaggtgttggtgttccataaagtctgggaagtctttgggcattggcctgagacagaatgggattctaggcccacctctggcaattactggctagtccctaaagtaggttctttagtgagaactaaatggtaagattctatgggctctttactgtggcatataggaagtgcttagcaaagggttctctgccttccttgcttccttcccccttcactgttctttccttccttccatcttcctttcctcccacctccttccctctccagcatgaccatgatcttccccaggctccagtggcctttctccccaggcactagagagctgctgaaggtgttagccaggctctgtctctaacagctgtatgtgaacagtatatcaagaaggtgagagttggagactaatctgtggacaatgaaaatgaaatcaaaaaagagaaatgacacttgggttgggcaggtggaaagtttgactctgggttgagcatgggtccacctgaatttcattatctgcaaatcataggaaattttgccttttccatctttgggcgttgtttgaaatgaggcctccttgtcggagggagggaggtaagtggggtgggtcccagagctggagactttgggcaaatcatcttttctctctggactgcagtctctccctcagtaattggaggatatgggaaagggcttgggtcttggagtccgggactgggagctgcatcctgactctgcctttactggtgctgaggccttgagtaggcctttgctctttgtgaacctggctttctcatctgtagcatgaatggtcactgtgcggcttgggtgaaccatctctggctctcatgatgtgcggggtctttccagctcttgagctccagagctgtttcagctctgcactcagtacttgaggaagatgttgttcggagacagtttacagagaggggtctgagtgaagggcctatgcaggctgctgcaagtccttgtctctccctcagagaagctgccttctctaaaggtcaggaaatctaagccgagctcatctgcagggtgcccctgcctgagcaggagactttggcagtgtgccccagcctgagataagatatctgttgggaagaatttcctctcagagcccagagttgggtgttgtgtactgctttgcctggacatacacaggtgaggagatgaggggggcaatagacatatcaaatctctagaacttgccagaaaaatgaggagcttagaaaatttaagacagagttggaccagaatctcttggaggaggggtccctgctgtggtctgtcccccacaagcatcagctgctccttgctgcccacagtggggaaggcccagcctcgggataccctccagaggccacatcctgcctcctgtgcccacccacctgagtatcttcaatcatgctcttcagtgcctccctggaagtggagatacctctccatgccactgtgaatcttaaatagaatcagaccattaaatagagtcagctgtccagggtctggcccaacccctcccactgcactgccagacagaggggatgagtggcaccttgcagtcccaccccctgagcagagccctgcatctcagttgagcagaacatggggacgagagcataacttcggcatcagccagacctgggttcaaattctggttctgccactgattagaaaatcatataacatctctatggctcaggtttctcatctgaaaaatgggaataataatagcacctgttgagcaaagctgagaattgaaggaaatgatgtttgtatatcatgtgcccagcatatgctggacctcttaatctgccatgaatgatcggtacttacttacatgacggcctcttccactgaggagtcagcgggtgtctctctcttccgcaagcactctgtggtagagtgagcgctgaggccagaccacctgcgtgggaaccctggctctaacatggcaaccagctgatcataagtgagttaggtaattgctctgtgcctcagcttcctcatctacaggatgaggacaataatagcaattatgtctcaaagagtccatatgaggcttaactaagaagccacatgtaaagccttggcagtgcttgatgtgtagtaagtacttaatcaaagtccactgttatcattattttgaaagggtccctagaaatcatttgatccaaattcctcaccttgccaatgaggaaaccacagcccagggaggcattaacacagcatagcaataatagaagccagcctcttggccttcactcagaacacgccaacaggaagaagggaggaaggctgtgtggttgagtgtgtatgagggcacaggatctgtgccatctcgctgcggccttgctgatggcagggaggtggcattgtggtgaattaggctgggattctgacgcactttcagctcccatgaaaagagacgtttgactccagaggatcccttgtgttcaagagctaacagggtggcctggttggggagacacaccctagcggtttaaggagggcctccccccgccatggggtggaccctacatggagagttagagcccgaccagacagagaggcctgacgtggccttggatagaaggagcataccctggagaattcagggctgatggttcatggtgttggcaatttgcacttaaacagttccggaaaaaaagaatttttttagaactatactttcaacatgtttgtgattgtttaaaaataaaaacttaaaaaagagaacgaactagtttggctcagaagaaaggagaccagggaagccaggaattgaggaaagagtttaaaagggcagaggctgtcaggggctgccgggcagagctccgaacaagcagaatcagccaaggccaagaaagggagctaaaggcatcagatcagacaaagagccgggcctgaactccaagcagaatgttggatctgtgtggtggatgggcgtcctctgtcaccataggtggcttgcaggccaaagaaggacagcccagctggtgggagctgggtcccggggcacagcagccagagaaggcagcctgggctggagcctgggtaccaggcggcgggcgtgctgggcaggcctgttcccaggaacatggtgacagcagacaggacggacacaggaggcaaaacaaacctaaggcagccagggaggagccaggctgtgagcgaggccttatgccccactggcaatgcagctggcagactggggccaggaggcggccagccaggggccaggccgggcttctgggaactggagccaggagcagacagggcgcttccccggggaaggctgcgaggagtagggacagccagcagggcagagggcggagaggctggtccgccggctgtgctgttcagctgggaggcaggacctttaggggcctgggagggcagtgtgttcacccagtccagttgagcccaggctgattcagaaagaagaggagccaacccctagcagagaggaagaaaccagttcccatcaactttctaaacatcagcagatggagcagtcgggctgtctctcggaagcatctgagactgcttagctcgggagcttgggcccagaccctacaaaccacgatttttctgagctttgtcacctcccagcgtctgccctctgttggttctgatttcaccaacgagtggtgaacccttcccgtgaggagggcagctgaagacgcatgtcctcctctcagtggtcaggggtcgggaaggaggaggggaggggctgagaggaggtggtggttggatgggtctggacctggggaacagagtgtccctgaggatccagccataggctgagcggtgacccaggagctccagctgaggctgaaggagccagcatgctgtggattcatacaggctgggccgtccctcacctggactccagcagggtgcccgtgaggtcttgttgctgcaggaaaaggcccagcagtgacccacggatatccccatgctggtccaggctctttcccttcccccttctaggggccagagtacctttagtcagccagcccttacctgaggggagaggctattgtgaatgcagtggggcctcacctggggtctggcaggacagggcatccatcatgcttgctcaaatcctcaccaaagaatcctaccccttcaccctcttccttgggtctcctctgcccggtgtgccaggaagggccatcccagcgcagacaacacactgaaagcagccagctgggctcctcaggtgttggaccgtctccctagtacaaccttgagactcctggatggcgtcaagcactgggttcctgcaggaagtagtaaggaggaggttggggttccagcaggctgtgcacacaggcctggccatgcaccatagggacccctctctacaccccacctgctgggtgggcctgggtgccatccctttcctctcgaggaatcagggtgctttcacccacaccacgctgggaaggttgcttccatcctcccaagaatccttcatgtgtcttgtcccctccctggactcttgggcccttggctnnnnnnnnnnnnnnnnnnnnnnnnnnnnnnnnnnnnnnnnnnnnnnnnnnacccaggagccaccctggctctaccccagtgagctggctgatctgggacgaaccgttagcccacctgtgcagctgctccttttctagggggtgactggaatagggcggcctcttggggttgaggtgaggcttaaatgagaaagcctcgatcgcatcgccccagcggcatggaaccagtgtgtctagagacggagtctggctcgcctggaaggacgctggtcaggcaggacagaggcaggaatggtggcggcggggagggatcaggagtgtggcctctggggccgggtccttctgcatcactgctgggtgtgtgacctggcacagtggctcagcccctcagtgccccctttctcatctgccgtgtgggaagagctctgctgacacaaccaagggctgttctgaggaccaaacacataaacgtggcagcttggtgagtcccacagctccgctcctggcacctcctggccggctttgcacacgcagctgttgaccaggaggctgggcggtacgtgggaagcacctctcagggtgcagcagtgagctgaggatgaggggcaggtagcaaaggcagagggtggaggagggaagatttttccagatggacaaactggcccaaggctagaggcttgtggtgctggcgaggctggagagggacaggagttgcagtgagtgggagatgagtaagccatggaggggcctgtgatggggtcatggggtcacaggtgtcagtgggggcggggaaggacctctgtcgcttttccattaaatggaaaaggccatattattcatccctttttaaaaaatgggaaagcataaatgaaaaaataactataaattttatagacactccatgcactggggctatttttaaatcccctgttattcctataactccattagacaattggccggaaagcctggctcagaaagaaccctgactggctccccagtcccctccagagcaccccgtgtttgattaggccccagaccacttccctaggtgccccagtccaagcttccagacatcccaggcttctctgcctctgctctttatcttgatgttccctccacctggaggaacctctcctcttctttagctccatatccccacagtggactgtcctcagagctcgagtcaaatggccctgttccatggagtctcccagacctttccccaccctgctgctgcctgccatacattgcctcttcttccgcagccccccagacccattgtctcaccttatcttgacttgcattattttctgtttggttcagacaaatgcatgttccccctcatggccagccttagagcccacaggcaggggaaatccttttcataaaatgcacttacagttcacaactgtaaactttaaaatgtaggcagtgggctgatgagaatgatctttggcatgctgtggtgccactcactagctttgtggctgagggcaggtctttgtgagtctctgggctcagtttctccgtctctggagcacagacagccatctctgcctcccaggctgttgtgaagccagaaggctggaggacacgtgcggtacctgcctccaatctcagcaaacactgaggagagctgtgggaaaccttagcaggctctgttctcatccagccgctctgagctgattctacatctcatctgggtgtcgttctgatcacagggttgccttcttgccgacggttgctctggaaggcacttcacgtggtgtgaacggcagatgtaagtgatgttccagggccagtgtgctagagagctgtcctcaggcctccaggagaggctgtgcactgactcagttctctactggtgcagggaggtgtggactcattgggatggagcagccctttctgaggaggtcacacccagtcccgtcagcaccagccccactttggagacgggagtctctggccaacatggtcctggctctgctgtcaatgttagtcactcagccatgtccagctctttgccaccccatggactgagtctgccaggttcctctgttcgtgggatttcccaggcaagaatactggagtggattgccatttccttctctgggggattttccaaacccagagatcgaacctctgtctcctgagtctccagcttggcaggcagattctttatcactgagccacctgggaagccctctgctgttaatgcctgtgtgaatttgaggggggacctcaggcaacttactgatctctggtgaccactgattgaaatgcagcacatggccccctggactgagccctgtccactccaacagtcccctcgccatcctgtccttcccttgcacccgcctaccctcccatcaacctctcccaccctctctgcaataatagcagccgtggcctattgaaggcttgctgtgccccaggtacagaactcagcactaaacccttcacaaatataatttctaattccatcaccccttgatgaatagtgtgtgtgtatgtatatatatatatatatatatatttatacacacacacacacacatacaaccattctccagatgagggggttgaggcccagagaggcgaaggaacttgaccatggtcacttgggtagtgaggaacagagctacaattcaaattcaaacctctgtggctccagatcctgggttcttcccttcacagccccctgccactaactggggaccctgctttctgcatcttctgattctcagtcacctgcatggcaaatcccagttgaatcctgttcctgcccctccacgtgcccctggccaggccctgagtggaccccactgagtgtttgtggatagagatgatggtgatggtgatggtgctgctggtgcggtgctgccccagggcccgtggtgaaggatggaattggcagggggaggtatcctctcccctctcataaagaagactctttggaggctgtctcagaagctgtaatcttttgagacttgcatccccagggtgagcagtggaatgaacagaagtgaggacaccagctccaaaaggtgagggctgcgcggggccgaggagagtggaacatgaggaaggcctcaaggagatggcccattgtgtgcttggggtgtaactcccagtccttgaaaaatgtcttcagggaggttcagaagcgtctacttcccctttacattagatgattccaaaagagccatgtccctggtggccagcacctcatgttcgttctctgggtttgctttttcacgtccagtgcctgatcatggccaggttcaccgaactggaggcagatgagatctgacaagttttcatagacatggcatttctgaaggataacagagctagtggtggcaacagtctgaactaaatgtatgagctctggaagctttcagcagccacatctctcaccctgcctccctctatgcagtgcccgtcccttctatcatgctaagaactctccaacgcattcaaagcttttaaccaaagagaagatgagatgtgatcagccagcaggagctcaagctgtccagggaccattcctgcttgtggatgtgccgtgaccccagccccatcctccagtggtgaggaccctcatttggctgcagcttcggtcagtcatttaaggtgacaggttgttgaaaggctacctgtaaacgtaaagctcacatggtccagtctgccaggcctccagggaagccttgttttctggttttcaagtgcaaaaactcaaatctctttattcttaaattcagaatttcttctaaatctgttcaccatcttgcacctctatcatcctgatataaatctgacggtttggttaacttcactgaggcttttattgaccctgcattttctttattgggtcttgatctttcatcacattgatttccatttcacattgatttcaaaactgtctcacatggactgctagagtatgtggtacaaactccctgtctggcggatcatgtgttgtaggaggaacaaatgctgccttcagccatgtattcagtatccaagtatggatgctggaatgcttcatgttccgagtcagcaattccatcttcatcactggaatttggtcctcaccatcatcctcttgcctatggtcgcagagggcttccaagggcttcagcatcctcatcagcatgttctgaattcctttgtaaatttgcctgtggctggggtggaggaggggatgatggagcttcagccctaccgcttcctgtatgagctggtcagtatatgccggggatggacattccactggcatcttagccccaaaccatggcttcccctttgagttgggagggaaggacatctctatgcttcacagtctatcaaaattggggacatttgttttccttacgttattttaatcttttgtccgtaccacacagcatgtgagatcttagttttctgaccagaggtcgaacccaggcccccttcattgacagcacagagtcttaagcactgcaccaccagggaagtccctcctcatattgttgaaaattaaacctaactgtgatgagcgctctcaacgcagagcgctagacagcagatcagatacagattgatccctgctatatgctaagcacagttcaaagcacataacctagactaacaaagttaacctcacaataaccccgtgagtatacatgttactttcaataatttaaaaaactgaaacagaccatacacacaaatggagaaggcaatggcacccactccagtgctcctgcctggaaaatcccatggatggaggcgcctggtgggctgcagtccatggggtcacaaagagtcggacacgactgagagacttcactttcacttttcgctttcatgcactgaagaaggaaatggcaacccactccagtgttcttgcctggagaatcccagggacgggggagcctggtgggctgccgtctatggggtcgcacagagtcggacacgactgaagcgacttagcagcagcaaacacacaaaagcaatccaagtcataaaagtacagtctatgagttatgacaaaatgatgtataattttgtataattatacaaattatgtccagttacccccaagtcaagaaacagtacaggatcctcattttacagatgaagcaactgaggcacagagaggttaagtaacctgcccaggatcacacagctaagggttcagccaagaggtataataataaagccataccacagccacagcgagctgctctgagtcgtcagccccaaccctgccacggggcaggaacatgctcagggccacacagctggtggcaatgaggcaggatttgaaccccagcagtctgaccctaccaaccccccaacccatgcctaaccactgcactctgcagcatcccaaacaaagcaagtggatcccaacttcaccacactgtagctgtgcaacctcagacaggtcctttcaccctccgagccatgaccacatccttccttcctgttttctcaccttatccccctgcgggctgtttgaggctggaactccaggttggatactggccatttagattccaactaggcccacctcaaatccagcctctctaccataggaatctattttgctcaaaacctgacttttagtctgtgcttacactatccatgctggggggctcactaccacccaagcttgctttgctccaagtttgtagctctggggttggaatattctattttaaaatgaacccagtccttcctacctgtcttggttttgcctgtggactgaaccacctcccaggagactgcattaattgtacttgtgacccgaggaatttgtggacaaatttctatgagcctggtttctcctctactcccagctggtagagagcagatctgctcagaacaagagccaagaaggtgcctgccatcatgggacaactagaatggaactctcttctcttcccctgtaagatttgagtctgtaagtctggggcccaaatacacagcccccttgtgtgctctgcaggttgaagcagctggtaatgccagctggccccttcttgaaaaggggtctgatgcgttgcagtagctatcctgctgccttcaaatatttgggaaagccttgctgtcattcagttcagttcagttcagttcagtctctcagtcatgtccaactcttttcaaccccatgaatcacagcacaccaggcctccctgtccatcaccaactcctggagttcactcaaactcatgtccatcgagtcagtgatgccatccagccatctcatcctctgtcgaccccttctcctcctgcccccaatccctcccaacatcagagtcttttccaatgagtcaactcttcgtatgaggtagccaaagtattggagtttcagcctcagcatcagtccttccaaagaacacccaggacagatctccttcagcatggactggttggatctccttgcagtccaagggactctcaagagtcttctccaacaccacagttcaaaagcatcaattcttcggtgctcagctttcttcacagtccaactctcacatccatacatgagtactggaaaaaccatagctttgactagatggacctttgttggcaaagtaatgtctctgcttttgaatatactatctaggttggtcataactttccttccaaagagtaagtgtcttttaatttcatggctgcaatcagcatccgcagtgattttggagccccccaaaataaagtctgacatgtttccactgtttccccatctatttgccatgaagtgatgggaccagatgccatgatcttagttttctgaatgctgagctttaagccaactttttcactctcctctttcactttcatcaagaggctttttagttccttttcactttctgccataagggtagtgtcatctgtgtatctgaagttattgctatttctcctggcaatattgattccagcttgtgcttcttccagcccaatgtttctcatgatgtactgtgcatcatgggatgcagggtatacccttaaataagcagggtgacaatatacagccttgacatactccttttcctatttggaaccagtctgttgttccatgtccagttctaactgttgcttcctgacctgcatacaggtttctcaagatgcaggtcaggtgctctggtattcccatctctttcagaattttccacagtttattgtgatccacacagtcaaaggctttggcatagtcaataaagcagaaatagatgtttttctggaactctcttgctttttccatgatccagcagatgttggcaatttgctgtcattgcctcacagctattccccagcatagagacacctgacattcattgtgggaatctgatgtagttcacagccttttcttatttgcatcttgaggcatacgaatctctgagcattgaggaaaccctgaggttccccagagcatggtggcatggcgcctcatagccattggcctgtaggcattgatcaggcacccaatgtctacacatatttcatcagctgctatcacagatggccttggtcaggctcccctcaactcgcccttgcatgccagcctcagggggtgcttccagagcacggctgtaagagaacactgtcaccatcccctctgacacaggccaggcttctgtaccagcccctgaggtttgtctaagccagcttccatccctgcttcttgccatatagaattgccgtatagaatcatgccaaggcttgattataattcctataatacatgcctaacactccacaaatgctagctgtttctttttccctaacaaaaaaaaacacctctgatcctggctgacgttctttttgtgctttttagtaaagagtaaaacatgcgtccagtctccaggatctggtcacttccccattcttgacctgtttcctgtctggggaacaaggaagtgaagctgggagaaccagccaaccatagtcctgcatcaggctggactggctccagtcacaacagggggcctctgggtgctctgggccatcccatcttaagagggacaacctggaggggttgggaaggtctggggaggaatctggaatccatcttgagcacatctgtttgaggcctggagcagaggaatcttggctagagcagcatcctttagggaccctcatgtgcaagagggcttgcactgaactgtgctcagactacagaaggtcaactttagcttagttaaggggagctctgcccagagtggaaggtgctgcctgggacaccatgagaccccaggtgccagaggtggacgcgcccaaggaggggtgtggatgggctgccctaagaatgacctcatcagagggtgcacgaggcccctcccacccaggaagttgaaggtttttaggtccttcccagcatgaatgtgctttaacagtgattttcaaattgattttaaattcacagaactcttttttacaaatagattcctattctgaaaaacagctcaatgcaatgagggacatggggacccagaaccctgctgctcagcctccccttccataaatcctgagcacagcgtgaaaggccctgcaagtcagggcctgctaaaggctggggcacccccatgtaaatgggcacctttaagaagtgcaccccttgttggtagtttcacttctctgaacacaacaggcccagtttctggcatcctgcctccctccctaatgtcactgtctggtcggaaacagggccttggctgcattctttgggcctgagctggtttcagcccaggctgggtgcctgctcggtggttcttaggcttctgcactcagtcattcattgcacagtgtctcaagtcatcgtattgattcctttagaataaaagccacctcctctttttagacctgagtgctgtgtgtcagacccctgagctgctgtcttcagggcagctgatgctgtttactgttgtccccctagaatgacaaatcacaccagaaaaattgagaaaacagcccaaatggcacagatgcaagcctgcaaaatagacacgggctggcctccgtggtgggagtgcttctgaaaagtgtaaagcaggcttcttgacctgcctcccctcctgtctctgtcaggcagcctcgactcctggaatctgtgtcctctttcctctcgcccttgcctctgccccatcttgggctccatacaattacaccaccatcccccagcttccgggcctcccagcccactccatccccaaccctgcaccagatggggactcccaaaacaggagtctccccagtcagacccgattcacccccaaaagccacctaagacccacccgatcctccatggtactttgtgagttgtctgtgttacaggttctctgtctttattttaccatcttttaagtacctgttattcattctggagaccaaggtcagagtcttatttagctttgcttttctgggccaggctcagaccaggcctttgtaagtattattgagtaaatacacagaatactgcttaaaatagaccctgctctgtcaggctctgagcctaggcttgtattacacatgtgccaaggaattcttggcacagcaggtctgtccctggaccccgcattaaatgccccccacccctactggctcagtggtaaagaatccgcctgccaatacaggagaccctcaatcaatccctggagaaggaaatgacaacccactccagtgttcttgtctgggaaaccccatggacagaggagcctggcagttcatagtccatggggtcgcagaagagtcagacatgactaagcaactaaacaacaaccaccccagatgtagtgatgtgacatgatttctgcagaaccctgacaaaatgagagtccgtaatgtgccccgaacccggtgtgaacttgccccatgacccacagctcagcttccccagtatacttgtcaccaaagggtgtgttcccaacctcttggcaacagaatatttttagcagatacacaggtcagtgccacctggcacttgctcctctttccacagacatcccttcctttctgagcctcacccagagagcaacgagtcactgcaaatgagctggtgggctcactgtggccggacctccggggggccagtgaccgccgggaaccaaccctgagcctcacttcatgggacacaggctgcccgcaaacatgggtcttctcagaggaacagtgagcacatttctggtcgcatctccctctccttttgcatgatcatacccaggctgtgtgcccctgggggaaagcatatttggctacaagatcataatacaatcagaattttgacaagactttaaaatatccaaatctggaggagagttgagaatttttagaataaaatattaacaatatatgaaaacatcaataatatacattcagaacagcctcctcagagctcaaattaggaaggtcacaccaaggtcattgagtttatccccctcattcaagagaaaaatgaagcttggtggaaagagaagtcatgggtttaaaggtcaagacaggtatctactagccacatgaccttggggaatttactttgagccacaagtttagctctgagctaaatctgcctctcctattttgcttgcctgaaactgtttttttttaaagaggagatttttaagtcttaaaatttcatagcaacatgtgaccttagttcaaattctgattctgtgaacctgctgtctgtgacctcaggcaggttactgagcctctctgtgactccattttcttatgtatataggaggatgattaaattccctgtgtcacggggctaccttgtggtttaaatgaggaaaggtatgcaaagcatttaaaatagtgttcggtaccaagtaggagctatctaagggtatgctaatattattattattttaaatctggattggtggttttcttgaaaacccggaagatctgacagcctcatacaacacttggctggaaaggtgtagccactccccctttagagagactgtgccctgccttctagctctcaacctctccctcctccttgtacctcctctgtttcactcagcgggtgtggccagctcaccgctcctccccaacacgctccctcccttctagggccctgagccccctgtttggtcaggaagcagtatttctgtttattggataaatttagaggataaacagggcttccctggtggcttagacagtgacgaatctgcctgtaatgcatatgacccaggtttgatccctgggtcaggaagattccctggagtagggaatggcaacccagtccagtattcttgcccctctgtctctgagctgccataaccactcattctcttgctccagggcctcccggcctggcttctgggtgaacagcactagtggcaggccgctcactacctcacagggcagcttcactgctgagtcttcatcttatgcagggtccaagaacaacagctcacctaccaccttgcctgagatgccatttaatttccactgcatcccctcttctggaatccagagcagagggatatgccatctcctttcagagctgtgcgctgagttcccaagtgcttgggcaaaacttcaggtttcagaaatgcctacaaaaaggctggagtcactacccaaggggtcacgtgctgaatggtcagagtcaggcagctcagcatctccagtggcaggactggaggggaagctgctgaaggcagggggtcagactgcgtcatccgtaagagcactggggtcagagctgggttccggttcctgcttcaccactttcgagctgcctttgtggctttgggcaagacacacaacctctctatttctgtttccttctctgtcagatgaaaataataagactcccgtgatgaagggattgtgcaagattctccttcttttcctttgaatccgtgagtctcagagctgcagcataagaatgaaaacagacccagaagattctggcagctccactcccctcctgggagcctcactcccctcctgacccagggcagtggaacagggaagctgcttccaggcgagggttcgggacccctggtgctgagtagtgacctcaggccctcacagccctgggcctcaggcagtcaagctcaaggtctctctaagacatttcggaatccacagaaacagctttttttttttttttttaagacaaaaccaagcattttccagactggctgacatccctggctcgtcagagcagcaaaagacaggcaggtggtggggctcagacagccgtgagtcagctgtacccaggctaggcacagatagggggccgggagggcacttcctctgcggctgaagggctgcctcagctggagggtggaggggccagcagacctgggaagcaggaccatgcccctgggcgccgcaccatgcatttctggcttccttccctggctctttgcagggcatttctctgcagctgtcaacaccctcagtcccacccagcgctggcagcctttcaggagggctgcagaagagcagtgttcttctctgtctgcagtcctacaggcccctgggcaccccagagaaggaaggtgctaaggaaaccttggtcagcatcacctaaaagcatccaggcagcgtctgtgcaggggcagggggacaaagtggaaaagtcgctggtggtgtgatcttgtccacatcacttgaactccctgggccttggttcacatttgtataaaatgggaacagtggccaagagctggtgggagggctgaatgacctcaagcctgtggcagtgactggtacacctaagggcaaagtttgactgttttcgctggaagggaagtgatttttccaaggttgctcagcacgttcacacaggagccaggactcagatccagctctcatgctgacctctccatgcacagagaggttcctaccagaaagtggggagcgttctggcagccagtccaccgtggttgggagggactggctgtgtgccgcgtccgtggggagcccacagtgtcaggctgaacttgtgctcagggactcgtgagagcatcttggctgagggtctctagcagacatgaggaaagaaggccctggcttggctcccgtctgtccagcaatgcctaccgagcacttgcagggcatcaggcactgtgctaggcccgggggatgcaccagtggatgaggcagacgtgtcccccctccatggggctaacagggaccaccctgtgagaggccacgacagtacacacagctcgacaggtgccgtgaaggaggagtgggtgggacccccaggcccacgggtgtgtgagagagggctctgaaggaagggacccattggcagagccctgaaggagacagacagactgtagcccgcggtggctggcgggggtcgggggagggagtgcagggggaggtggaagaccagaggaaagggactcagaggcacgggatgacattcggtgtggttggcggagaagtgccgtgaagggaagagctggaggggtagctggaccaggaggtgccccggggccttcagcacccgctgagtgaggggcagggctttaccagagcgcagtgggaggagcatttgagtgggcccttgggctgtgaggagcggccagatgggcggtatttggggagagtcccctctggctgtcttgtgaagacagcagggtaggagagaggatggtctgccctgtggccgcccggaggtgggcctccctggaacacatgtcgcatgtggtgttgacgggccgtggtgatggactgaccgacaagactgaaggatgtggaggcaccaaggatgctggcctggccaccaccgggtgtgcatgccatttactgacgcggggacccaggaggcagtggtacaggtggggggcatggaaacaggattctgggaacgtgggttgcaaggtgcctgaagaccaccgggaagacgccaagagggcagctggatgtacagcagagcggtcagagctggagagacaagaggagtcttcagcatccagggggaaagtcaggtgtgtgtggaggagctcacctggaggcaggtgtgaggggagaagcatgcaggttggtacccgcagggagggtgggggtgcagagaaggaacttgccgaggagacccggtcaccaagccagcaggtatctccagatggtaggcaacggggctcacagggtaaaaccactgtcactcagatttagcagcccgtgacattgacaggaacagtcagcaggggagctgggctggggtggcgaggagacgtgactgccagcaggacggccctttccagacttgggctgagaagggaagcagatggagtggtcgctggagccagctgaggtctggcgggcgggggctgctgttgcttggtaccaagaggactgagcccgcgcgcacagtggtgggatgtgtccaaaggtggaggcctgaagctgcaggggaaggggtgggatcttatagggagacccctataaggggccatccaacctccagcacagactggagggactgagcctgggctgggaaggggaggagggcccagccgacaccggacagctgccccacacctgtccctggacttggtcctttgggaaccaccaagctgcacaaccccagtactggcctttgaggagcagagaagtcagaggctccaggctggccaaccagaactgccctctccaagtcctgggagcccaggggccacccttcccctgctctccatcacctgactgcctcctcctctcacctcttttctgtggctccccaatcacattctctcctggttccttatcaggatctctctgcttgggggtggcttttggcaccatccttctacccacccttacctttgggtgcttcctgggccctctcactatcctttttctgttttcatactctcttgagtagtcacctgcctcctcacaaagctgcaagtcccatcctgagtcccatggaattctggttgtgtgtggacattccttcaattctctcatgagcatctcacattcagtagttaaggactagactccggtaccatttctctctaagccgtggctggtaccacctgaactagctaagttgaaatctttgttcctcctgcctggtgccccctgtatcatccagacagccaccaggatttgtagattctacatccagaaggcttcgaatccctgtcgtacaacacgtgtgtcttgaacccagactgtttctcctcttgcagaccgttccccatggcaccaaggaagtatcttctgttgagactttatgtttacctttaagacaactttaaccaagtctccatggcattcaaggctgatggtgatccagtctgccctgcccacaaactctccaggcatcttaacactcatgcctgtgcggctggagtccctgcctggggtcctcccttcttgcctccatctctcagcatcctctctagcctctcccaacccaaggctgtgtcccagcaggctgtgcactttccatgcagtgtgacaaagtggtgtctggggttgtgtacctgccttctcaccccaccccccaagtcacagcaccaccctcgggggatcgagcagagtcctttctctgtgtacctgtgtgtctccacttgggcacccacctgtggtttaaactcgctattgagggagaatgaaggggctgagagtagccaaggtcgacggactgtctgcctgcctccgagctgtcttatgtacagagggaagcacacatgtggtagaaattggagcatctgtaggcctgggtgggaaggggtgaaagacaggggacccataggctccatcatggttggaagtgagaggggagaggctgtcatggaacctctgagcagggcagtgtggaagtggtgtggtgtgtgcgtgcatctgagcgtgagcgctggtgaacactgtgcctctgcctgcctgctccctccctcagagacccctcctgcaggcccatcctggtgacatcctctcagctgtgagctgatggtcccagtggaacaggactgagtcccagccgctgtcacttcctcaccttcccctactccaagtcccctccctgcctctctgaagccccacccagaggctgggtgggagggagatgtacaggtgagtgtgggcataggcaggcctcctgcttggcataggaggcacactctgcaggctgagaaagccacacctctcctaaggcgcctatgccctcggaccctgggtctcacagtcagaaagctcttctcctggaattatgccaggattccctccatgggccctgccgcagccttcccatccctgccaagacactcacacgcacatctacagtgttaggccaatgtggcgttctgacaaggacggtatcgagtgagcttgtgggactcatgggttccttctaagtggaaataagagcattctgattcacggccaagagcgcagtggccctgaggcccaagcaggcaggccaggcaccccaggaggcacccgcaagctgtcggtacttcctgctaggaccccaggtgatccccggagagagacctggtggctggaatctgggtcctgagagcttcccgctcggctcaagacggaaaatactggggagagagcttcaggccccgggtgtcttgactctgaggaccgggaaataaagtgccctccgctctcccgtcacgtgcgcgtctggcgggcctgcgagcggactgtttcggtgctggtcgcccctcgtgggggatggacaggctctggggcaggcagattcagaagttctgtccctttctagctgtgggagcctcgggctctccatggaggttgtgactgaatgtgggcaggtgtccggcagagggtgagcatggctcagtggtggctgccggagctgtggctgtcatctcttttagtctctttgttgcacggtggcccagagcggctgctctttggaagcagaagctggtgctgaggctggatctgggccagagaccctctgtgcccctgtggcttccctcccggcccggagcaccagggcctgttgcctctgagggagaggagggggtgcaccccccgcacccgtctgaggtcagggcaggtgcagagctccaggcggattccccacccctggctgtctctgctccgcgtccccctctccccccgcccctaagagctggatgtggccaggaagcgcgtgcatcttctgaggtgggaacctgcctcctctcctcctgttttgttcctttaccatgacgcctgttgctcataggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaaggtaagagacggtcagcggagcgctggccctgcccgctgcagggagctcccctctgggagctccagcacagagcccgaggcctggacctctctgcctggggcctgagcagccctgatttccgggctccccagttacagagcagcccactgcagacggggcagtggcaccgtcggctgcccagcctgtcctcttagatctcacactggccccgtccaccctccacctatgcgattcccaccacggccaggcagtggcactccagcgcacagctcctggttttgtatttgatctcatcaccctgcttccttttgcatgtctccttagccctttatccaccgacctgatgagttccagcatccacactggtcactgccactcttgagtttggaaatccattccaccctgagccacttaacacacttgcatggtcacttctcatgccagactttgcctccacctcgcctcaccactcagactgtgttcccgctccacccagcttctccacagccctcagcactgggcccggctctcccctcaccttgactggcagccctgtcattctgccctggccacgcagcacctcagggtcagctcaggctctggcagtcacctgtgagaagaaggcagactggccagtgagggtatgaatccagagggctgtgttggatgatgagggcagccatggctgctgcagccacccaggacccaggcgtgaaccagtgaggctgagtctgcgaggcttggacagagtgtttctctatcctcccacgggctgctcctacagggcaggaaaggcatcgtgacccacttcttctttcctggtagccgagtagaccaaggtgcctcagagggaggcctgggctctcagtaaccctggtggcttcagcctcttgtgtttggcagattcctggctcaggatttgggcacgagggtcctgccttccccttcgggcaagttgggggcctccacaacagccccctccagggccacgtggcttttcagtggatgcaacttgagagcaggttcggctttggtgcccattagccttccttttgtgggtatagctgctcccagagagagaggctgggtggctttgaggaggcccctccggactttgagtcttccttcttcctcctcctgatcccttccattctgtcagtgctaggttgggggtcagtttatctcacccccttgctcacggccccctctctgactgggtgctcatctctgatctgctgaccccattagcctgtcctcctctgtcctcggcgccatcattcccaaatggaactcgaacttttccgccaaggttttggttcgaatacaggcgaccatcctccttccttgccctgaccctcttctttcttggtgtctcatcaacaacagtccagagggcccagagaggaccgactggcctgcagcccagccatgtgcaggacagctcgcctagcaggcctaggtcctagtcgtgggctccgtgccccacacacccccttcagccccacttcctctggccttagggggccagttgggactttctggaggagagaggtggagattcaacaattggatagccattgaccaacaattcagataatggtctttgactctgaatgccaaaagctgtttgtccaagccccaccatgaagggaaagaaaatgagtccccccgcccctgcccaagccagaaatgactgttaaagctggagctgtaactatcagctaggacccctgcctctggggcataacccccaccaccttcctctcttccccttgtctggacggactggcaaaatcaggtggcctccagagtggatcactgctggcccaactcccaggctgtccagcggaccacaccattctgttctcagcgtgacgagcccagtcctgagagtgccccctccaccgcacccccacccccacccagcccagggccacacagagctgcctaccatctcggggagccatcatcctctatgtgagactggaaagatccattgagccaagtccccagccagagcagtctcccagagcaatctctattcaattctctctggctttattgagagcaaaggcctggtctttttctgccaagtctgaaagaggtctgggtccctggcaagaacaccccttttccaggagattcctgcattggaagccacatagctgagctatctgcagtcccttcctgggtccccctgagccctggagggtccagagcacacaacctgcatggaatgtcagtgggccctctgagtgcccagggggcggagcctgggatgaaacctgggggtggagccctgaaggccccgcccaggaggatttcctctcaccctgtgatggggcatgtgctgagctctctgccaaggctcctagacccttctgaaagacaaaaaccttccagagccagagcagtgagtgcatctgagatagtggaatctcaaactctgggaggtagaaaggggctagtatgggcggtgacagatggaagcagagccagctcactttggctctctctgcatgaggcaggagagtgagggaagccatgagacactgaagctcccttgactcctcagacccttcagccatcagcccagataccaaaggagctaccctcctctcagggctcctgcctccgtccagctgcctccgtctcctccctccccttgtccttgggctcagactcgccaggctgcatgagaaatgaagctgggcccggtggtcttcagggccctccgtcgccactacctggctgcaccggctagagagccttcctgtccgtctctgtccgcctgtctgtgtctccgtctctgtgtcagacgttgtgacagcagctccggtcctgggtgctagcaccggcttgtctcagtgagtgaggccggggaaggcccactgggatgtccctatggaggtctggggtcctgtgtcctcttctgagaaggttccccgaggccagcagaagggctgtggtgggtacaggcccttgcgccgatcgcctgcggacagagctggcagtttggagcagccctcaggggctgagggagggtggttggtcaaagcccaaagccgaatggggtagacacggttttcagcttatgctcttggtagaggatccacctgtgttccagatgcccatcatttccatccgcttgcctttcctccttcattccaggatggtcagatttggggtgagggggctgggatgatgtgaaaagctgtgaactctgcttggaaagctgaggctctgacccttgacaaggaaatggtgtccaggccaaaaaaagacacctgcagccatttggttcacctccttcaattcacagaggagcaggcaggcatacagaggggacactcagggagggtgctgggtaacactcagggctgcacatccgcccctatgtccccatggcctatcccagcagccactcagactcccagctcctccctgcagcctccggggcaggggcagaggagaagctggtgtccaggggctgcctggtgccctctcctgggattgctgagcccagacagactggtggaggcatttacatctcagccatcatctcagcatctctctctcctccacaaccagtgcgtggctgtggcagagtctcccgggtgctccatgaacactgactgttggggcaggggggacacacagaatgggaaggagggaggttccacgcagtggcatctgctctctgccaggcacgctctgctgccactctacatgcgtttgttcgtccgcttctcccagcatccccatgaggtaggtacaactttacagttgcagaaactggggctcaaaaggttaagacacttgcccaagaacacatagctagcaagcgacagagcccagactcagacccaaggccaccaagctcctacatgtcttggtctgtcccaccagtatggagcacgcaaggcacctgcagtcctgagacctggctccagacggggctctgcgctagctggcaacgtggctttggctgtttggttctccgtgatggtgaacaggagctgtcccagagcatcccgtcacctcagacagtggattatctcgtccagtggcatcattagcaccaaggccaggagtcagaacagaagcaggaagaccctgggcctggtagggggtgggtcacatggtctgggaggttcctcccgacactttacttctgtgatgagaagaacatttcccactcacggttattacgcgcccttagtgtgctcagcacctaacttggttgagtaagagacccaacccttccggacagaacagggccaacaataatgtcatagccaaaatgagcagtgtgcatagtcccctggggtctggggtattcaggggatggcaggctggtctcagaacctcaggggacgtttggtctctctggcctatgtaacactgcagctgccttgaccgccccctgacatcctgctcaggctttgcctactcacaacagtggggccagaggcccatgatgttggacagggacgttgggggtcccccagccctgggatgactctggaagttatggctgtgctccccatttggccaggagtagaagatccagttttctgtccagttaaaggaagaaaatctgagggagagatggagtcacagaccaggatgagcaggagggaaggggcaggaaacagctcctctccatcactgctgcccttgacctgcacacctcaggcagcctcagcttaaggctcctgttacctctgagcaaaaccttaaggttccttaaaattctcagaataattaagaaaaaccctttggttcatgcatgggtgctctctccctagtcacccacccatcctcccgttgatccatgtctcccatcctcgcatcctaagagcttgtcttcctctcgtcttcccatcttcccctctcgtctgcctctccgcctctctcctttgtcctcccaccatccacccttccatcctgcccgtcctttcatccccctctatgtctgccttccctattgggtgtgctgcctccatccccccatccaaccagccctctcccccttgcccagatctccttctctccctttctccatcttctcatctgtttagggatctactccccatctacccttctatttatttttatcctccatctgtctgtgcatctgcttatctgctcatcgagtatcccacccgtctgtctggattctccctcttcatcctgtttgtcactccatatttcctcttacccacttattcatccatccatctatctgtccaccaatcgttctatgcatctgttcctggaatcccttcttctcttttccatccatctgttcaaacctggtaataagatgagtgagacagagttcctgactcaagggccttgtgatgtattatatgaaggaccatggaaatatagccatccctagagcaacagtgagcacatcacagttggaggcgattggtgagcccaaaggaacatcgtgaggcatctggccagcatcctgaggcgagctggggctctcctgctggtccttcgcagagcgctcctgcccatagggctttgtgacctgtgaagcgctgtgcacacgtcaggaagaatcggtgtcacagagtttcccctgattccacagagcttctggctctgctcttcagcccactacggacagagtcagccaccccccgagggctttgtagtcacggggaggacggagcctttgctcagccttccctgtgcccaccacccttggccatgtctgcatggcagtgactttggaggcccaggaaggggacatgactctctaaggaagtcaggacttggaccccagccttgtggcccctaggtccctgtctagcagacttcgctatgccgtctgccctttctccatgtctattaatagcagtaactttgtcctggttcctcctcccaaaccctaagatccctccctgtgggctggcctagcagtatcctcagccagaaggacatcctcagcacccactcccatgctagttcatgggctgggtccctgctctcatcccagcatttgaaatggtcagtaatcctgtcaccagctcctgggcccagggttaaatcagaaaaacttttgcatatgacttgtcttttaatctccttttgtttttttaaccagcatctcacttcctcattataccctctgtccgctcacagcccctcacccaccctacccggctcctctgtacatcgtgcacggcggccgtggctgcacccctgacctgagcacgcgggcagagtgatgtcnnnnnnnnnnnnnnnnnnnnnnnnnnnnnnnnnnnnnnnnnnnnnnnnnntccctcctccccctcccccctgcccaccttcccctccctcccctggcccccttgcccgccctccccctcctttctgtcctccttgcctctgctccccctccccttctccttcctcaccctcttcctcaccctcttctccagtcttcccaaatacaaagagacaaaggctaagttcacggaacgatggcacccacgcccctccttcttacagcacgcgcctggagccagagcacttgagcattgctgactgtcacgcaggtagagcacccggcacccggtgggtgctcagtgaatgtatggtggttacattaatacacgagtattatagtcaacatcgattgagcatccacctgtcaggcatactctagacacgtgccgtggttatcttggcaaaccctcacaatgacgcagtgaggtacatacttttatatgctccacacccacactcacacctccacactctggacatgggcttggtgctcaggtcttttagagctaggggctttcaagagacccaaagccaggcagacctgacagccccctatcacctctcaatcccaccccacgtcccagcaccacaccccagcctcagtcccccagtagcaagagtagagccatattagggccagtttctgtgaacacaaggcagagtggaaggtgagtccaagtcagcatgtctggccgggccctgtcgggcctcagcatccaagaaggaggccagagcagctcttgggggtagataagcaaccagagatattcttctgcagtgagcaaacctttggccagatcccctaaaatcagggtcaagagagtgtgaaaaagcgaggtgtgtgttcctgtgtcttgtttctttctgtttatctgatttgggaatgtatgtgcagtcttaaaaacaagttagatcatatttccttttaggtgaaatgaatcagctttattgaacagaatacactgaactcagagctgtggcctccaaaatgagaatgtggggttactgagttgatcaagaaagcacgtcaagccatttacagatgtcttattaagtcctcataactgtggtagaaactggtgtcactcctttttaaactgaagacatttattaaagctcaaacaggttatggaagttgtctgaggtcaggcaaaaaccactccatgtggctccatgccactccagtgcctggggggctggacaggggagctgcacccaagcccagagccctgcctgggtgggaggcagggtgtgttcactagcaccgcaccaggggtccactgggcaagttcagcttcattttcccagtgaggccgaaaatgatgaccagatgaccttgtttgagaatgcctgaaatcagtgcagtcgttctagaaataattcctgccagcaccagccctattctaagtcctactctaggtactagaggttcttcaatgcatgaaatatagttcctgtcctcaggaagcctgcattctagaggggagccgggtagtgaacaaatgtggaatagggcaagggccttgagtatgaaataaagcatccatgacaggtagggaagtgtggggagtggcctctctgtttaggtgatgtgagccgcgaacatgaggcagggggtcaggaagccacgtggagcctggggaagggctctctctgcaggtggaacagcgggtgcagagcccctgaggacaagagttgggaagtcagagacagctgcggctgtgaaggtcaagggatgggtttagccgcctgctggagcgactgccctgactctgtacgcagaggatggccggtagggggcgcggctggaggcagtgatgcaggctgagcacgtgttggactggggggggcggagggaggtgaagaaacgtgctgttaggttttgctgacacatcagggcgggggcaggtggagggtgaacgcatgagaataaaagatccaaggatggtttccgaggtttatggcctaggaaactggaaggatggagttgccatttcccgtgatgatgaagattcagggaggagcttgtctgttagacgcgaagtggttgggaggtggccaggccggcgccgcagccccgcccctgagggtgaggaggttgagcaccagcgccaccgtgtggccagacctccccagcgccccggcgcgcttcgttccacccgtcccttggctccagagaggcgggactttgtggagattgacagtgaggggtattaggaattattgatcggcaggggcctcccgtagagctctgcaagagcccagatgtggggggcctggcgaaccttgtgctgggcacgggaatcttggattccgtcactcctgagttgggtgcctagggcagggcaccagccctctgtccctcagcgtcttcatctgttacagactttaggatctttcctgccgaatatcaggagccgctgatcctgactccctgactggtagcactacccctctgaccttcaactgcagcatgagatgctggccgtgctgcctgtgtgttgaggttgtggggtacttggggtgagaagagctgaggtttattgggtacttactaggtgtcagaccctcacaatcctctcagcagcttcatgaggtggcttttattattcttacccccacccccaccattttacagacaaggaaactgaacccagagagaaaaagtaaattattcgacattgcacagtaaggaaggggtgggactgagattcaaacccagaccatttcctgcttctcagtgcataaaaacatttttaaactggcagtgtaatgatgtaggggttataaaccttagtcctgactcagccattactttctgggtgaccttggggaaacatttgcctgctctgggcatgggtttccccacaggttgatgagaggtgaggctaggtgaactcctggagctaaagtcttagggcaaagctttagggtatgttttgcctccccctcacgacccctgctctgtggtccccagccccttccgcctctctggtcattctgctcccagctgccaggaggtcatgcccttggcctcccttcacctgacagctccaccccgcagttttttatctacatcctcttgcatgcccgactgtcatccatttgctgagtgctgagctgtttgaaagcacaaatgctgggctttctggtcccggtgcagcttggcatagtggggtccagagaagcatggttgtaccagtgacctgagtcagctcatgtgtccagctctcttagttagtagttgagtggatgctgacatgagcgtagtgttgggccagcaggacccaaaccctcaggatcctgccaggtgggcgagatgttagcggagctctccccagagtcctgattgctgccaacttcagagatgcccaaactaggtctgtgtcctgttagagctgaccccgctggtggggctgccccagcagaagtcagaccaggaggctggtatttcagagctctactctcctccccagctgggagcaccaggggttctacaagcaccttctctggacatgagtggctgggaagaggccctctccgcaggctgaggtcagcttagccaaaccttccaagggaacagggcctgccacctgccagatgctattgtgccaggcatcagcagcgtggccacagtggcaggtgtgtatgtgaactgaccgtgcccagtgctgctggccccgccagcatggctgctgtattccagaataatagatgtctccatgaatgcgctgagtggctacagttattaatatttgagcccttgatatgtgccaggcttgtgtttcctcctcctagcaaaccttatgagatgagactgtcatattcatttgacaaagatggagacagaggcccagcagagtgacttaacttgctcttggtgaagccaggactgaatactaaccaaaaagaaaaagaaagggaaggcctgtcttgtttgctgtggtttgatgccagccttactacttactttgcctgggcaaggtaaggtgaactgtctcatcttagttccctgtctgtaacatgaagataggaatagtgcctaccgggcaggattatttgtggattaggtgaattaacgcacatgcaggccctagagctgaaccttaacatggtagatacgaagtcatttttgctgtttacaaagtgctcccataccctcaacgatcttggccgtcaggcggggtttgtggcacagagcagcgtggggtgcggctgtaacctcgggcctcctgtgtctgtccctcaggaaccagtgatgacccattccaggactcggaagggcgagagggcgcagaggccgtggcagagcaccagttttcagacctggacgactcggactcggactcggacctggacgaagacgaggatgaggacgaggaggagagccaggacgagccatcaggcccgtcctcggaggcgcccccacctggcccgccagccacgctgcccgcagactcctcacccgttcagggccctcagcccacagaggccacccggggcagctcggtctcagaagccgagcgctcggcacccagcagctgctccacatccagccaaagcatcctgtgcctcccccggctggcaccggccccccggggcccagtggagaaggacacaggctcggccctgagctcccaggccctgtccccaaggaggccgtggtccccaagcaaagaagcaggcagccacctaccactcaccccaaaacactcactaaccaaaagctactcgtctccccagcgacattcaccggcccgagagccactggcctcagccccgagtccgcctggctcccagacgggccctctcccctgcgggtccccgagactcgagctgtcgcctcttgccctccaccccctgggaagggaactgccacttcgagcgcgcctgccccccgaacgcaagggcgctgcagacccaggcccccccagacactcgcccaccaggagatggtctccaggccaggccgagtcaccaccacggtcagcgctgccagggaagtgggccttggcagggccgggcagccccttggcggccgagcgtggcccaggctcagggctggccccccgggctctctacccgcccgcgcctctacctcacaagcttctcggcagaagcccagcggagacctgcacctccacatgggtgagttcctgtcccccaagtggctgatgggtggggggccgcgagctcacacctccctgagcgtcacacccagagctggacccctgccagttcagcggttaccaataaggcgtgcattgggcaccacttacacaggcactgtgctgggtgcctgaaaccagtcagctgtgtgtcagaagcagcggagcatggactgtggagctggactaaaagaaagtgaaagtggaagtgttagttgcacagtcatgtccaactctatggactgtagccggccagactcctctgtccatggaattcttcaggcaaaaatactgaaatgggttgccatgcccttctccagaggatcttcccatccctgggatcgaatccaggtcttcagcatcacaggcagattctttaccatctgagccaccagggactacctgatagtttttaaattctggactacccagaattaaatccgggttctgtcacttacgagccgtgtggctttagatgtggtataaacactcatgccatctcctcccaccccatttccacgtattctttgagcagatggcagagcccaacccaaatctccacatctccaacatgactgccaccagcaccctccgagtcacttgagccagctccttcccatcttcccatcagcaccgtcactgtcacatcatcagtgccatctgccatcagtacactccagccaccccataggcttgatcaccgtggtcacaacatcactgccaccaccacggtcacgatccccagcactgacacgttatcatcatcggcttacttttcctctcccaacaccttttctgtcactggagtgtcacgacccaacatctctgctcaccgccagcagtgtcagcaccatcactcaagcgattcaagctccaggagtagtaccatccaggaatcttaacttggtttttaatttggggctcaagttaaaattcctggtggtgaaaaagtgaaagtcgctcagttgtatccgactctttgtgactccatggactgtgtagaattctccaggccagaatactggagtgggtagcctttcccttcaggggatcttcccgacccagggatcgaacccaggtctcccgcattgcaggcggattcttggtggtgggaggaggttaagagcctggggtgggaactcatgttcaagggtaaagttgggtcagtattgtctgaggaacaagagaggcagcagaagcaagagagagggccagcgcacagaagccaacagaaggggcagctccattctctgaaaacgaacgcgctggccagaagcgtggggaccttggttcctgagtgtgcctatggccactatagggctggagatggcccattccagagagggcacccacccagggtgccaccgttggcaagggttgggactcaatggtggcccagctcagctaggacctgctctgtgatctcgccaagccccctcctcactctagtcctcagggtctccaggtgcccagcaggtaaccctcgccttcctctgtcttcttttctgaccctagcagaaggccgagtcgccaagtccgtcctgttcacctgctcccgctcatcctctcttctcccgacccttctcggccccccatgacttccacggccacagcccggcccggacggagaacatcttcagccacctgcctctgcactcccagcgcttgacccgcgccccgtgccccctgattcccatcggcggaatccagatggtgcaggcccggccgggggcccaccctatcctgctccccgggcccagcgcggcctgggtcagcggtttctcggggggcggaagcgacctgacagggtcccgggaggcccaggagcgaggccgctggagccccaccgagagctcgtcagcctccgtgtcccccgtggccaaggtctccaaattcacactctcctcggagctggaggccagggactaccccacggagagggggaggacgagagggggcctgggcagacctcccgactgggagccccgtgcggcccaagtgcccacagagcccacgccgacgcacagcccccgcacccccccagagacctcaccccgggcacccccaggccaccgggcagagtcccggagcccccacctggagtcaccgcgggtgccggccaaccctgcggcctccgccaccccgccgctggaccgcagcagttccgtgggctgcctggccgagaccgctgctcgcttcccagcccggaggaggaacctctctggggaacccaggaccagtcagggctccccccagccctcgggaagtggggggtccgggacacctccacaccagcccgaggagcgggggccccggagcacttag

SEQ ID NO: 3 - DNA, 5925 bp, Bos taurus
aatgagctgtcgctcagcttggcagcaggacgctggcagcaggcacactccgcactccagcccagcctgagcgtgcctcaccactgtggtcgccatgcccaccgccttgtgctccatcgctctagccctgctcgtggccctgcacgaaggtgagcaccccccacgggctcagcagctgcagcagccccgaggctgcttgtctgtatctcctgctggggctctgtgccccccaagccagccgggggccttcaggggcaggagttaggtggcttgggggctgcaggaggctgtgctattagaggtgctgccgtcccaggacagccaccggtccttccaacccagagctgctggggcttccccaggctggcccagggctcctgagcactgagaatgccaacttcctcgattatgcaagaggaggagcccagcgggtcccccatcccagctgtgccaggcgccctgacccacctctccacttttctctccctcctgtgcatgcaggcaagagccaggctgctaccacccccatcccagagcaaccagcgcccttgccccgggcccgaggctcccacctgcggactcgacgttgctcctgcagctcctggctcgacaaggagtgcgtctacttttgccacctggacattatctgggtgaacactcccgggtgagctactggagggatccaagaggggttgcagggggcaggggtggggaatgctggcatgctggggaagccctggcacactgcagctctctcttggagtgtggggctaacaacaatagcaatcagctattgcttcagttctcacgtgggggctgcctgagcaagacagagggctgtctcatgaaaatcctcacaaaaagcctggtcagaaagtgttggctccattttccagatcagggtactgaggctcagagaagttaggtgccttttccaaggtcacacaggaagagtaagtggtaggtaggaggctccagcctaggtctgcagatgccagagcgcacagcggctctgccatgctgcctctgtataatcttccaagaatgatatgattaatgacagcacccatgtcttgactgcgccaggccctatgccaagcactgctggtgcgttatcacctcgtgaacgcacccccatcctccccagtgaagcggggactgctgctgtccccaaatgacagacaagagacctgccccatgtcacctggcagagccggggtggggtcccagagctgtctgttctgtctgcacccgcgctgcctccgggccactgcatacttcaagttgaagtttctctgtgtgtttgtattttttttttccttctccaaattgcaaaagacaagagaagcccggcacgtaagcgtgtgtggagctaatccgcatccaaacactggctcagggcgggaaccctgccagtccctgcgtgctgggtctacctggagtctctgcagctccaaccacaccgtctaaaattagctcaggcatccgaggtgctggtctgaccggccacggggccctgcccttcgcctggcccgtctcagccagacggaatctgaaatcgatctcagccaatctaatatatctatgcacacacacgcacacgtgcaggtcaggcacacgcaccattttaaagtcaaaactctaagaaacacttgggtcacccttccaggcaagtggtgaccggatggaggcagctgagctgtgagcctgagtgttcacttctgtgagagggcactctctccctttcttccagactagttgggggtcttctttgagaacagggggaccagcctgactccatcagttcaaattgctgtctgggagtgagaggggcagggaggacagcttccacccctcccccccatgctgagcgtcttactgagcaggaccagggcagttgggagggaacagaggcccgagagggtaagggtcttgcccgaggctccctggcatgtaaggaggaagctgcagtgggaattcttgagggcaggagctggttacttttgctgccaccctggtggcatggatggctatcccagtgtgcagtgtggacagtcccagcttgccaatggtcctggtttatctaatcctctctctgtctctctccaccctacaccactaccttgctggcggcccgcccacagacagacagctccttacggcctgggaaacccgccaagacgccggcgccgctctctgccaagacgctgtgagtgctacagtgccagggaccccgcctgtgccaccttctgccatcaaaggccctggtaagtgggcacccagcctgcaaggggccagaggtgactgctggcctggacctgctctggagggcagggtgtctggaaggccagcagtggcggactgttagtccctaggtcgtgcccgactgtttgtgaccccacggactgtagcctgccaggctcctctgtctatgggattctccaggcaagaataccggagtgaattgccattcccttctccagggtgtccaggaggccagcagaggcgtggctaaatggtggaggaggggccaggggagcagggtcctgggggtccagaggctgccctgggctgtggggcagcctcccttcctgcagggagccagtcacccttgagtcttcccccctgccactacccccagctctgggggcttctgagaccattgcgtccccactcctgggcaggaggaatcctccccaggtgatagctgaggcagcacaggtccagagaggaaacaggacttgtcctgtcaggctacacagccagttagacgagagctgggccttccgccttagtcgctggggctctgggacctctggaactttctcagtggagaagcagtagctggagttggggggccatggcaccgtccccgagctgccacaaagcgcctttgccagtcttttggccctctggacctccctccctccacgcggagcgttgggaaagcagacagtgacttcaccctcccctacctcccgctctcatgaaggcctatgggaaactcctcccctgagacctcagctgtggctgcagccctgcctcagtttccctgctgagggttctgcttggctgcaagtggccagactctgggaaggccagccaccccactgcctctttctgaggctgagaacgcattcccagtggctcagttttcctcaggccccaccccacctgggaaaagaagggtgccaggtgcacagggtggaaatggatctgctcctgagggcgggtcggggcggggggctgggctgggcctgcagccaggcagcctgggggccctggacagcccctcacttgggccctaatgctgttcactcaggactgatgcggtggcagtcccaggcagcgggtcccctgcagctgcgttccaggatggcaagacacaggccacagcaggagagctcctccagcggctgaggtgaggggcccctacactgattgagtgccttctgtatgccttgcacatttcccttattctccatatgacgccttgggtccttatggggcagccaatagcagctcagacagatgaaggtgtttacccaaggtcacagagcaagctacagcatctggctgactcaatagcctgtgttcttaaccactatgctctttgttaccgccaggcctggaagtggacttttattgagggtttcaaggcttgtgactgtggaaggttcccaggtgttcattcaggctgtgtctgaatcaagcatctcccacatgctggggtccaaacggatgctacccagcctgttccctccctgggtcccagactggactgtctccctggtagctacaacatggctcagctcaaggcttggcatccaggaggtgcccatgaacgtgtgtccaaccaaactgacttgagaacagaaacctatagccagtcatgtggcagggtggctgaaggggcagcatctgagctagaaagtcccagccctgccacgagcaagctttgtgaccttggtctgctcactgaacttctctgtgcttctggttcctgtctgtgaggcagggacaccgctgctatccatctcacgggcttgttgaagtttagagcagttgacatacatgaagagccccaagaaagcccaggccctacgggagctctgaaggttttagccatcccgaacctctgtccctgagggttcctcagggctgcccagggccggggtgcagcctagcccctcaagggtccacatctctgtgaggaggcggaaacataggcaaaaagacaggatggccggctaggcaggacccaggatatactgaggaactatcttaaaaaaataataataaaatgaaagtgttagtcactcagtcgtgtctgactctttgcaaccccatggactatagctcaccagactcctctgtccatggaattctccaggcaagaatactggagtgggtagccattcctttctccagaaaatcttcccaacccagggatcaaacctgggtgccccgcattgcaggcagattctttatcatctgagccactagggaaacccaggaaatgtcttaagatgaaaaacttcaaggtaagactttgcaagtacttggcattccataattagcaaagagtgttttcgccagtctgtactcagcctcacaccagttcaggcctgtgtttattttacagaccaagaagggggttcagagaggttgagacccttgcccaagttcccaaagctgggaaccagcctcccagttcccaggctagaacgccttaagccagagtgaggccacctagatgacggcagagcccctaccagggtctcagccagattcaaaggactgctaggatccatacatatctggagctggaccttgaagaatgggaattttagggcacggagtatggggtgagtggaaggtcaacagcctgaagagccacagggatagaggtgtggaagtgagagggcaatcaggggagagccacggggctactcttggccgtgcagtcaccctggtggcacttgatgttgagcatcaattttgtcaaagctccttgtgggcagaaaagcttctaacctgccccggcctctccttgaggttcagaccttgttttcagggttggctgtgaccaccctctgacctcttggccatgaataaggaatccagaccctatgaccgctgcctctcatggggaactctcaagtgatgtatatctccagagatgctcaattgacctctttccatttcagggttatttctgcaaccaagatccactttgctaggcaacagcagaagccgacgagggagaccagacctacacactccaggcagaggaagagatagctctcgactctgggagaactttgggaaggaagcctgtgtggatacaggaggagaggggcatcccagagctgggagaccttccgacctgtttcctgggccagaaaacccagctgctggagcaggcacaagctctggcctcctcgccctggggagggggcctcgctcaaggcagctccgtgacaccaggaaagtcatcaggccccaggctgcagcgtggcctcccacactggctccagttcctaggccctgctgaaaggaacggcatgcggaatgtgctagcctggaggtgtcctgtctggcggctgtgaaccaggaacaacgtgcagtggcgggcactcacacccaagccagcccgagtccttccagggttgaagtcccggccgcccccgacccctcacccccgctctgtcccctccagccctcgctctccagtgtccttattctcccttcataccctcggggcactcttggtgagaagggcctgcaccacttcacctgtctgtatataacttatttgctctaagaaatttgacgattccgattatttattttaacgtatttttttagactctcaattatttacctgcgaacttgtgtttgtaataaacaacaaaataatgc

SEQ ID NO: 4 - DNA, 21469 bp, Bos taurus
  unsure (484)..(819): sequence is unknown
  misc_feature (485)..(820): n is a, c, g, or t
  unsure (13367)..(13416): sequence is unknown
  misc_feature (13368)..(13417): n is a, c, g, or t
  unsure (16577)..(16759): sequence is unknown
  misc_feature (16579)..(16760): n is a, c, g, or t
  unsure (20478)..(20529): sequence is unknown
  misc_feature (20480)..(20529): n is a, c, g, or t
tcagcctggcacccagctctggttggggggcggggctccggccaggccgggcggcggcggcggcagggccgagtcgaagttgaagtccatttcgtcgctgtccatgaagtcgttgaggatgatggactcgacgtcgcactcgaggctcccgctgaacatgtcgaggtccaggtcggccgggaagcggtcgggcgcggcacccagcggcccggcggcggcggcggcgtacggcccgggcagcgcgtctagcaggaggccgccggggggtcccccgaagacggccgcgtgtcccggcggcgccagacccgtcgcgcccgcctcgccgggcagcgtcataaggctgatggggtgggctaaggcactgcgcgagggcgccggcggcgcgtacggggccacccctttgccagggtaggtgccggcagcgcccgccagcgccagctccccgggtgcaccaagcacggggccggccctgggcgcgggtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgcacgcggataaaccgggtgtgcagagacaggttgtgccggatggagttctgtggccagagacaaggacaggggtggaggagtgggcagtgaggggataaatgatgggaagaggagtgggagaaaatcgaggagaggaggagagaaggcgaaaagaaacgccaagaagcagaaggggaggaaagagggaagatgaaagggtacagcggggaagaagggggaacaggtgtaagtaccaggtaggacaaactcagaatatccatcccccaccccagaaccgccccaccctccctgttcgcagcccgcacaggcactgtctgtaggatggggccggagctttgggtctagtcttgccagggaggctactcttgaggagccgcctgcagcaggggagcaagacccctctccccaactcagccaagctctgcccggggctagccaggctgctagggccccccaacagattatgtaagggctcatgccgctgcggctcatttgtccgccccccccccccccagcctggcgtggcgccaggagcccgaaaacccagggctccagaaatcaatctcgcggtgactgattaagccctgtttagaactaattgctctttcgtgtgtggggagaataaattacctgctttaatttcgtgtctttaaaatgcaactgcaggtagagaagactgttaaccctttgctggaagggtctggccaggataagcagaatcggctgggtgtccccaaggtgggcagaggcccacattttctccccaattctcggagcttctgcgaactccactccgatcccaggacacccctcaaagcacatccatcagccgtggagacctcaaaccccacagctgctcagtacccaccttcaggtcagcccagttcctttccctccccacccacctgatgcaaagtagctttgccctcaagccccttcctgcacaaaatccccacaaagcaggtgacatcatgcccatttacagacaagaagactgaggctcagagagatgaagtggcttgccttaggccacaaagctctcctgctgtgtctggtccttcctcgggcttcaccttagccacacctacacatatcttcttgtaaatttctgttgggctccatatcactgcctacttttgccaggcctggcctggggacagagggaggcaggggagtccacagctccactgacctggctcctcacagagaacatggaggactagaactactgcagagcctaccacgccccacctctggggcctccctgctggaggcctggactccctggctctggcactgttgtggaaatagcaggggtttgggtatctgaagggctgggcaggatgcctggctcttttcagccacctagctatgtgaccatggctgttgactcaatctctaggagtgcatacctcagtgagctgctctgaaaaaaatgggcaacatacagtaaccacctcggaaagctgttagatcattacctgagataatgtgcatgctaagtgtttggtgttcataaatgttggtcaaatccctcactctggccagaagacctcacttcttagatcactccacagacttactccttctctacaattcttaatatcaggccctgagtgtacctgcgctgggcacaaacaactctggggagctggcattaccccatctcctgtaccagggaatggaggcccagaggcatgatgtaacttgcccacggtcccacaggcaccactccaggtctgcccagcatacggacctgctctcatccccccagccccagaacctctgatccgtccaggctctccctgctgcctccttcccacctgactgcaggaggggtcctctctgctgcccagggcgcccacttgcccctcacccccagcaccaggcacgcacctgacttcttcagggccccaggctccttatctctggcactttctggtcttgggagacaacagctggggccccaaggcccctcccagcattgccctgcctggctcctcctggggccctgagaggaggggacccagacccccagggagtggtgctccctggagtagaaacccccctttcctgctcccgcccctgcacctggctccccagcccctccccaacacctgtgttcagggacctctgaggcctcagttctcaacccctgtgggactaactgcctagccagaggctccacctcgcagcccctccagctggaggtcagtcaggccacacctctttatccatgtcactatgtgccagcccggttctgagtgctggagggtgggaggagaaggaaggatgtcaccaagtagggcatctcctgagtacctgccgggtcagccctggtattgggagtattttatcccattctcagtactttatgatcattctgtcagtgttcatataactcagggactgtgacccctatctcaagatgttctagggaaatagcaacccactccagtattcctgcctggagaatcccacacacagaggagcctggcaggctacagtccatggggttgcagagttggacatgacttgatgactaaaccaccaaccatctcaaggtgaggtgactgagagagattacgtaagttgtcaagatcatacagttttaagtggcagagccaggcactgatttcaggttagactcactctgagtctaaaggacctcacattccaccatgggagagagaacaagtcagagaatttccaaagaatcttaggaaaccagtcctccatttcttctcaaactttccatgatgtaatcaaccctagaagctggtagcatgggaagctgggggcatgttaaaaggtcaaaattctctaagagtcttgcgtttcctttttagaattcaagggaatcttggcttgtattccacgagacttccaaattttctgaatatcaatacaaatgttttagatcaccgtcaagaacacacattccaggcctatgaaggtctctatccttccccactctgttccttgcccagccaggtacccctaagccccagcctgaaaccacagctggttggacccagagagaaaaaaggacttgccctgcatcacccaggacctggtggcagagctgggattcaagcccaggcctcctgacctgcagcttggtgctcctccctgtcctccagcaagcctgatctggggccactccctcttcctctctgggcctgtttccctccccagaaattgatgagatgggccatgcactctaggcacctttgcagttgacaacgaaaagttcttggaattgttcaggccaggggttttcaaacttttttaagtagtggaactcttgtagtaaatggaatctaacacaaaacatgagtgttccgcactcaagccactggggctggggtgggggtaacctggaaccttttctgctcagcaccctcccttggcactctcacagaaaatggcccttggcgaggaattctgcaggccacctggatggggttgacgcttagtaaggtgccattctttgcccaaggtcacccagggaggtggcccagagctaggtgaggacttaggccttggtctgctgagcagggctcttcaccaggtgtgcaccagggctgtgccccaggaggccaggccaggccctgcagctcattctggctcctcagggcccagccacctggtacccatcagagctcccggccaagatcctgtggcaagcactgatcacatctcacccacacaaggcctcctgggaggccagaggccacggaggaggtgagggagggggggcagggagacgcctctgccaggtagcagtaaccagggttccctctcagagttgcctagcaacccgccaccacagccaaggccccggcatgcccaggctcccctggtgcccaagctgggcttctggggcctcacacctcccacaccttcatgcaggcctggtgcagtttccaggatgggacctccctgacttggtgcctcagcgagactatcgggggtgggggcagagggaagggacagggggttacatcccagcccctcctactgtcctgcagaacctgggtgagaggccagcctgctggggcctcagtcaccagggcgaggaggctggtgcaggacaaagagcagggctctggtgttggatccagattccagtcgtggctctgacacccacaagcagttgagctgcatgctttgaacctccagttcctcaaacaggctacctgcctccacccttgtttcccttgagccttccaccaggcagcagccggagggatcctataaataacccagatcacggtccagtcctgcccagaacactcatatgcccccatctcactcagagtaaagaacaaaggccttaccatagcccaccagcccctctgtgacctcctaggctcctctcctgacactgtcctgcttgatccctcccattcttcaaaccttccaggaacctgccaggtaccatcccaccttgcccagatgcccatgtccatctctcagctcaacaaagtctctgttgagatgccacctgcgcaatgagacctatcctgtccgctcttaacagatgttcctctgccttgccgtttcttggctccctaaccctgctctgagtttttctaaaacaattagcactttctaaagtactgtataatttctttatattatgttcattaatttgttatctgggttcccttattttagaatccaagttccatgaagcatttctgtccctttctttttcttaccagaccccatgtgtttggtgtatgccaggcgtttcataaatgtttgttgagtgaatgaatgagagacagcaaaggagggtaacatagtcttgcagggagaattaatgagattggcagagtgacttgcacagaataggggctgctccaaactgagagaacacaggacagaatgggaggcaagcaggggtagagaaggcaggagcatcctgggccacagaaggaagcacagagaggaggaagggcttcggtgagagggaaagtagggctcccagggtgaacaaggcagctgcccaccctggccccctacctgctcgctcctgctgcccgaacagatctgggtaacccagggcttgctgcggccaaggtctctagcagcctggaccatctgagccagaagatgctccaggagcccccaggggaacagaataacctcgtccttgctgatggtgcctcccccatggacagggtctgagctgtttggtggcggcagctcatccatccaacgggacaccctcatctattcccaggacacccttcgcccacgagcagtaatgcattcatctgacaacacaaccccatttatccagcacaccagtcccatttatccagcaagtacaacctcatttgctaacagcactccattcacctgacgggccccctcatttatccagcaggacaccctcatttatcctccaagtcggaggctctccttcctcctgtggtgtggctgtgttctctgatggtgcaacccgcctgatccagcaggacgtcatctctcctacaagtacacttcatcccctgatactgcaacctcatttatctaataatgcagcctcaccttgcctccaagtaccacctcattccttgacagtacaacctcgtttatcttccagctcaacctcatttctcctcccagcacagcttcattccctgatagctcaacctcatccaatcttacttctccagccagagcccagcagatctcagggctggggagtgggggggaaagaggaggggtttggagcaagaagaagggtcccaccatttgctgtccctggcctatggagggctgcctggcactatgactatatccaatcttcccaggcccctggactttgagttctaggttgcatggtccagccagtgctccaccattgccccccacctcctgtttggtccccttgatggctaaagagaatccacaggatggatttttttttcccagctctccagcaaggaaaaaactccacctgattagatttgtagcatttgctggtttctgtggcatgaatattcccatcgtagccaattttaagctggcagcatgatgtcactgagcgcagaactgggaagaagttctccctgatcagctctcacgagccagtgcaagcccactctcacacaccactggcacacactcacataccaaggcgggagaagggcaccacctaccacgtgccagacctaagctaggttcttcagatacatttcttctgtgaattctaaaagccatccaaactgtggattcagttcagttcaggcactcagtcatgccgactctttgcaaccccatgaatcgcagcgcgccaggcctccctgtccatcaccaactcccggaattcactcagactcacatccatcgggtcggtgatgccatccagccatctcatcctgtcattcccttctcctcctgcccccaatccctcccagcatcagagtcctttccaatgagtcaactcttcgcatgaagtggccaaagtattggagtttcagctttagcatcattccttccaaataacacccaggactgagctcctttagaatggactggttggatctctttgcagtccaagggactctcaagagtctttctccaacaccactgtggataggtaatgctattttatgaagtgggggtggagaggggaactaaggctcaagtaggttaaatgactcctgagaccacaaagctgggaagtgatggagctaggtctgggtctcagggctcttgtattccaaagccaaggttcttctcactcacatccctaatgaggtggggaacgctgccctgctacccacctcagtggccatccctgccttgattctcaagcccaagcttcctggctttcatcagagacaggagacccaagtgttacgctgcccacccataacaagccctgtgctaccccctggcctctagtaccgaggggatcccaggactctcccagttcagtcccggatcttgtgtccatccatccaacctaaaaccaggtatggttgcctctccaggttccattgctgtccaaggttctgcctggccctgccctcaggaagctggccccacctacccaatggggatgtgacccagctcctccctttggtgcctcccagagcagagatcacctgtggggctgcatgagtgctctgattccctctgtgactcctgtttcctctctccttccttccttccctcccttcctgcatgaagaaatactgagggctagaattggaatcccagcctcatccatgtgaccttgagcatctcctgtaaaagacagtaactatcccaacatccatgggaaagggagtgaggccgggaagggcatgacatcccacatcttatgatcttatggagtccctatctcaggcccaggagcaacccttgtaccaccctaaatcccccacccacctctgacccaggaacacacctgactcagagagagtcacaaaaccgggggttgggggtggggaatctaggtaaggaggagggtcacttgctctgctgcttggagtactcagtccagacagacttcctgggagaaggagtgacctagatgacctcagggccctgaggccacatgcaaacccttggtactagggtctgcagggaaggaggggtggaagtgcaggcaggagcatcagagccacaggtgttgacaggtgaatggcttggagtcattagtggaacagaagtgggcagccaggggccaggaggaaccaaatagccaaagcaaggcaggaggtcaagagacaggccctggcatcccccacccctgccaccccagagacaacagagcccacacactcagcctggacagcaaacaagccaacagcagaagtcccagctcacccctactcaaagacccagggctcctcatcctccagactgacaatcaagggcctctgatgctctccagcctcgtcacctccattgcttacacccacctggaactccagccaccctggatatctcacatttcctgcctttgcacactgttccctgtgcccttctctctttctctgtgcacctgggtcctgctctatcaaggcgagctttgtggtgtctttcccctctgcaagcccccaaaataactattccctccccatttctactgaaaaaatctacctgtgcactagagtgtaattgtggatgagtctgcctcccaacttgaactttgtgggcaatccttggctcacggtaagtcaatacatagattggaacttcacggtaagtcaatacatagattggaactttcagcagccatgaaccactcaggcctggcaactttgccatttctgttccgccaaacctcaggctgaagttccaggtattggctcctcctcctcctggtttttcctccagttcctggtgcctctgccacctccctactctctgctgactcctccggagacttcaacaagtggagaaggaaagacactacgatttgctgagcattcacacacacgctggcactcaacagtttaagtcttactgagtatctgtaacaaacctctgagttagtttattattctgattttacagaggagaaactgaggcttcagggaacaattgacctgctccagggataagtgttgcggcaggaattcacaccagggtctgtgctcttccgcctaccctgagacacctctaggcgagcctaggccagacagaaactctcctggggaaagggtgccaggaactgccacgctggctcagcaacccctgcacagatctcctctctcttccaggattaaaggggatccccagttgccaagccattcaggcccctccgagcccctcctcattctgatcccctccctcactctgctggcagcacctcccacacccctgccccaggccttgggagcagctgcagtgacctcacccggccctgccctgagcccagctctggggagggcttagcagctgtgccccagccctgcaggcggctggggggcagggggtggaaaggaagagtgggcatggtgccaagagaaccatctgctctcccaggggcatggccacccgcacagacactggcctcacccccaggggctgcccttggccctctgtccccatgccaaggggctccaggaggcctgagcagcccacccagactggggcagcagccctcatctgccatctgtcttctcccggagcctgagaggtccttgcagggcacattggagcatgaatgtccgctggaaaatgaacaagtgcttggggtaagttctagggggcagaggccagaggccagggctgggtgtgctgagcgctgcccgcccagccccagtcttgtcaagccaagagcaggcaatcccctgggggatgagggcctccatcccctcacatctgctcagctggcaggtgccgctggcagagggcaagccccttcccccacagccccagctcaggttacaaaaggaggcaaggccagctgaggacagggggaggggacaggaggggtggaggaggcctcacagcttcccagggtattgggggaggggagcttggatccctagatgggacttagagccagagagggaaggaccatgcccaaggtcacacagcctgccagtgggcaaagaggagccagcatctaggggcaggcagtgctgagttcaagggtaaccttgggtaaatcactgccctcatttgtaaaagcacagggcctgaaacctgcctgcttgccctcaaggcctcagggaaagctctgtaggctagagagcagcatatggaacctcctgattccctcacaccccagggacagaaagggagggactagaagaagtcttgcccccacccccaacacacacaagtcagtgtctctcagggatcagggcccaggacccccaccctacccagggcatagacagtcatctcctttcctttgccagagcgatgaacaacaataacagtatttgctcagatttcactggggactttacatttaactctcctcagatgtaattctcacagcaaagtttggacatgtcttatcatctcattttgcagaaggggaaactgaggcttggatgctcaaggctacacagggtgagtggcaaaactaggactgctcctccctgcttgcctcaagactcttacccgcactctgtcttacctctgagatcctcgacgcaccaaagggtgctgcctggcacttcaggcctgggatcttggggcctctactctttctcagattcatcttctatcctggatcgcagtatgaagtccacagtggcccctgagccagtctcttcccctgccccaaccctccataccatcctttctgcccatgtcatccctcatcccccacagcttggagtgccaacttcttggtgtggcattcaaggccactcactcaccagccagcccctgcttgcttctccagcctcaagtgctgctgggctctggctaacatagctagaccctgtgaggctcccaaagaatcctgactgagggtttaacttttttgcctcattctcttccctcacctacaaatacccacagcgaattatctgtccctccatcatgaccctgggtcatttttatcctcatcttatttccccagctggacctgcaggcattttgagggcacagagccagtccagttcctctgagcagcgctgcacagtgggtgcccagtgggtgtaggcctggattaaagtgagtggaggaagcagccatcagccccggggcctgcagatggagagggggccgatgtcagctccctccctctgggagctctgggttgcagaaagggagtcaggatcccagagccaacccccaggctggaagcctcagggccaaactccaagggaaatcagagagacaatgttgcgggtggaggccagcctgcactagcctggacagagcactgggttagggaggaatggcccatgggagtttcatctctgtcactgccagtgggatactatgagagcctactttgtgtctctcagcctcactttcctcatttgcaaactggggacagtagcggtaccagcttcacagtttgctatgaaaattaaatgggagcacgcctgtcacggcccatggtggctgcatctccagctggaagagttctgtgtgtggctgaagcaaaggtcagaagacagggctgagtgatgtggctcgagaggttgactggggccaggaggccaagacctggagtggctaaggccccagaactggtccctgtaagaacagcacacgtggtctcacctcccccaccagacagggagctagcagagagcagggactgcgactttccggttcctcacgggccagcgccaaagaggtctgccgaggattcacgccatgaccgttcccctccctcctgcagccaaacgctctgtggcggagcacaggagacacggagggcagaaggcgggtgaatggattctggggggtggggggtggtgggagtggtttcagtcccttgaagctgactgcatggggctcaactcctggaggacccagaaagagtgaggaagagaggtgtgggctcaatctgggcagcctgcttggaggagaaggtggtccaccctgggaacagaagacaggagggacaagcaggagtcaaggaagataccatcgaaggcatcagttcagaatctgacctgtcaccagacggacctgttaaaatacagatttcaaagctcacccgctgacagtctgataagagggtctgagacggggctgcagactgtactataaaagcttgtaggtgactcagatcaccagccagctctgccaacacctaaggacttaaggcaggattctcagaaagacacattgggtttcagaatcacctagtaggtaggtttttgttcaaactacccaagcacctgcctagtttctgaagggtgtccccagggatcagcccctgagagtcgacagcagtcttggcgagcagttgacaatggcagtggtctgggttggcaactccagtgtcaggtataaagatggcagtgtgagggcagtgtgggatcgatcagaggcagcaggggcaaacaggagagagggcggggcctggacacggccagcagagggcccaggggcccgatcagagcagtttgggcttggttggctcccaagggaactgagtagccctggagggttctggagtgagcatgagtgagccctggggcaggaggactcattgggatgtgggctgacactgcaccggcattgggagatggtgacacatggtagaaacagacaggtctgcatctgaacccaggctcagcctcgtttcagctgtgctgccttggcaagagacttgccttagaagagacttcgtcttttcctcaatttcctcagctgcaaaatggggctattatcacatacctggcaggacccagggaggatgaaatgggaagatttatgtgaagtgcccaactgactgcctagcacccgggagttaattctcttaattcttgttccccttcccacaagaggcacccctcttagagaccagaaaggtttctctgcaaagacggaggccctgggtggggggagggcccgctctnnnnnnnnnnnnnnnnnnnnnnnnnnnnnnnnnnnnnnnnnnnnnnnnnncctcccccacaagccacctggcccccctcccacctccacatatgggttggggggtggggagaggcagcaaacagccaaaccctcccaaacaggagttggtttccatggtaacgagggtaccaggaggaaggggggcgctccagatccagctgtcccccctgagcgccctacccgggccccagagcctctgctgatgcccacctaacaccctggacccccatctgcctgctctggggggacagctgggaccgccacgagcactcccttcactgtgctcagagtacgtctgccacctgggtaccgccaggggcagggtaggcagccccaagcaggagcccccagttcaagtccatccacactgctactcactgcgtccagccacgagaagccccatcagtactctgcgcccccaggcccaactacccatcatggctcttagaacgagagggtttatccagttacagctcccaaaagggccagagactgggtgagttaaggccctttggctatggatgagaacacagaggaccagaacaggagagagctttgctccagttcaacacactcgagatgacggtcctctacaggggctgtccccacccctcacccactcccaactccacagctccaacagaccctgaggggctgagctagggcacctggcacaatgctccagagagatgggccatggccagagagaaggaagaaaggcctaaccacccaaaggcctgtctagtgacagaatgggcagtgctggaggctgcaagctcccagcacctcggagtgtgtgagaaagggagtaatctaggaaggagccttgacagcaggtgatgggctccatgactccccaactctcctggagacggaagtcagacttggacgtgataggaggaggcaccaacgtgaacctgtttctcggggacacatccacaagatggtaggcaggccacaggctcagatagggaaggggtgctgaggagtcagctgcgaggtaagggagacagtggcggcggggcgggggcggggggcggggctctccctgctacagccataccctagaagccctcaccgaagccttcgactacacctgcactcctcacaagacacagaggggcttccaaagctctttggaccccatttagcggccaccaccagccaccactcaaaagataagagaaggtgggctgctagaaacaagcttgccccctttccaatccctccccaccccagccctaatggcacaggaggaaacacatgagtttggggtgtataagggggttcagttctcaggtctgccagttcttagggaggtgatcctaagacaagtcttctccacctgggaaagtgggatgctaataccagcctggaccggtgggcgcttgctccccagccctctgagcccttccccttctctggcagagcccctccactccactcagttctgaagctgggttctcagggcctgcagacaggggagccccaacccgcagaaagtgggggctggggggggcactgaactttcgaacctgcacacccccctccccgcgccgttcattaccttaacaggagttaaaaataaccgtctcatctctttaaattagtctgtctgcaattaccgcctggcacggcgctgcccgccatcgtcccgctggagcggcgccaggtggcaggcgggggccctcaccctgtctgtcagtctgtctgtctgcctccgggtccgcccctccttctcccctcagaggtgcagctaccccaggggcctcctggcggccctgcctctcgagctccccaagttgctggggaggggcggcccggggggccacgcacacggctggcagaactgagggggccttcgttgaacagaggactgggaggggatgggggcgggggcgggggggcgcggtagcgggggaggggcgccgggaggcccgggaagccggaagggcccgccgcgcgccagcgctcgtgggtgggtgtgagcaggtggccgtgggagtctgccgggcgtgccagcaactgtgccaggagcggctggcacgggctcgtgcccaggaggcgggcagctgccagccccccgctcgtgcagcgcggggggtgaggacaccccccaacccgggctcacaccgcctcctcccacacccccaccagccctcggggctggggatccccggaggacaaaggaggaggagggagccctgctggaacgggctgcggggaggagagaagggggagctctgcaagcaaaccactgctcagccgggctgtcgcaggaccctcctcctggcctcagggagcagcccctcccttctataccccaccccacctaggacctactggccagcctgggcgggatggggggtagggcaccacccctcctgatcccaccccacaacagccaagctgctccaggcactgagggagaagggaagtccccctccacggggctcctccccacccatcctggggacagcaatgggaggcacccaggtctggcctgaaagctcccaggggagctggcagccaggaaacacaaaagcaggcagaacaactccaggggtgctaagtggaaggagcaccaagatccagagtagcctggaaggcttcctggaggagtccagcactagggaaggaggggctagagtgtcagaggaagtgggagaccctacttggatggtaagggacagggaggcctggcacgctacagtccatgggggtagcaaagagtggacatgacttagcgactgaacaacaataacaacctggatgtgggacagccacacttccggaccctgtagagggagggagacttcctgtccaagccctcggccccggacctggagaccctatgccctgatggcaactcttccagcctctccggcaccaagcccagtctctcttcgggcttcagcctgctgggtgccttgcgcctgctgatgatcttgcctcctccaattcctctctgcaacacctctgaactgtcatcccacatccctggttgggccacagggcaaaagtcaagcccttcctgatctggcccactcggcctttcccatgacacagccctgccccctccaggagcccttagttccagcctggcacgcccaacagtctcccaaacccagcgtatgaattccacctccctgtctttgcatacacagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttggaagtctttcccccaattctacccgccttccccacccagtgaagacagaccagactgccacccagtgaagacagaccagatagagtgccatattctctgggagggcttgcctggctccccaggggatctccctgctttcaccacacccctgtcccccagccctgtcccccccagtccccaccccccagcccttcctgcctgtaaaacgcagggcttgggtagccgtgatgcatcctgaaggtaggtccaatgcctcccccactggtccccccactctatctatcacagggttcagtacacggcaggggctgaagggcaacacttatgtgggggaggggagggaagaaggaacaatgggtccctggccccaaccctggcacctgaggtgtcccataggctctgtaaccagagggtggctgggagttgggaatggcccctccacccagcccctggagggactgactgggaatgggggaacaggtggtgggaggggcgggaatgagaggggaaagaggctccctggggagctggatgcaggtgggatagaaggaggacagccattgaggggatgagacgggaaaggccagaggtctttctgaacagccctcctccgctgctgcgggggtctctgccagggtctaggtgaggagcccaagcctgaggacccctcaccaatgccccagcccagggcaagccttcctgagcccaggcacagggagaagcagtgtgtccccagcagtgtggtgcagaggaacccgcatccaacgggcaggcgggaggcctgggccatcatccagggcctgccgctcactgatgacctaagaagagtcccattccctgccagggcctcagtctaacagtctgcaaaatgaactcatgggactatattatctccaagtaccttcccaatcccattctcagatttagatccatccctgtttgaaagttgccagtgtccccctgccacacccagggcaagcaggacactattccagaggctctgggtccctggagggagacacacagagattggaatccagctttcccatctactgactgtgaccttgggcagtttgcttctccactctgtgcctcagggcccagttctgtaagtagtgacagtaaaacccacctcaggcagtgcagagggcattaaaggtgacacctggcgcagatgcctaaagctgcctggcagagggcttggccctgagaccctcagtgcactgtagttttttcccaggttcaagcctcatgttccctcttgccatcttccccatcatccctaacccttcaactccaattggagctccgcctcctgcaggaagccctcctggcttgctctgactcacagtatcctccctggtctcagcaccctctgcactatccactcactcctttactcttttaccagacatgcactggtagctcctggtgccaggctctatgcttggtgccatgggcacagagattgatctaaccactgccactgttttccaaagagggtggggaagggaaatgagacaggacacaaaagactaagacttatgacaggtagggagaggacctgagctagcgaaaaggggttaggaaaggcttcctggaagaggtgtctgaactctgcccttgaggacaggaattatccacaaggagaagcggagggtgggacagtgcaggggagggaggtgggagcaaagcacaggacccacttaggaggaacaagtgttctgctgggggctgagcccagggggaccagctagaggatggagagaaagactcaggcctgctactccagcctgcgtccccaccccgtagtggccagagagacagaggagctgccagcataaaggctgagagccatgggctcccaggtcaactcccaggtcaacacagccaccgggcatctcgtgctgttcatgtccacaagcctcccctcctccactggcacacctccttcccctgacactgcctaccaccaccagccacagcccttgccctccatttaggcatgtctccctcatagagaccccctcttccacagggagcctgacagcttacaggccctaggcatggcctgaccacccctaccccccagcctcctctcctccaaaggcattgactatatccattccccaacaagttagccaggggaggatctggaggccacaatccagtcaagaccccgtcctctcccaagatggctcccccctttccagtggttggtactgaggcctccctggggtgcccctcccccttcccccacccccaaatgcatctgggctcagaaaatcagggaagtgggagacagacagcctggggtgggcacagacagatccccaggtctcaacaccctgccctcacaccagcaggggtcatcaccagcccaccatgctgatccaggcaagggggggacagcagctgccccatggagaactcagatcacctgaccagttccccaccttagactggctggtgccctagggtgaactcctggcactacagaaagaactgtgggcctagggtcgcattcctcaccctgaggccagcttcagggagggcagtgggaaagatttgggaggaaagcagccaccggcccggtcattatttcagctctttaaggagggtgccctggtggagagggtaaaacaagagtaacagaaagcaaactcgggaggtaacagaggggtccccagtgtctgaggcctgagaataggctcttctgctatgcccccaaggatggggtgagggtatccctcgggggtgcctcaaagtggcagtcccttgtcaccctaccagacctcccaccctgcatccagagcatgcacacagctgctcccagcacgcccccgcctgtctgccggccggccccacgccctgggcacacactctgtgacccctgggggtgccccagggtttccctccagaccaactaccgggtgcccagggacatctagcagcccttggaagccccagccaacggctctagcacccctcccagccggacgcccccaccttccagccggccgagctgttgctgtcgcctttatccttgaagtagggcacgtaacggaccatccagtcgtagatctgcgagagcgtgagccgcttgtccggggcgctctcgatggctttggtgatgaggtcggcgtaggacaggttcccccacgcgttccgccgagagctcttcgctttccgcagcggtccgacctccgcgcccagcggcggcgctggggccatcggcggggccgtggcccggcgctccggcccgcagtcctcggcgctctcggccacccccgaacccagcgctccgtcctcgtcgccgaccaagtcgggctgcggcaggggccaggtacacgagcgcggccggctctgcggcgcgaagtccgggtccacgtccacctgatgcgctcgcagcttcgcagccatggtcccgcccggcttgggcgaggaggggaggggggctccgcggagggtgggcgggcggctccgggatctgcgcgccccggggaggcccgcgggaggggtccctggcggcgccggctcaaccgcggggcgccatgggccaggtcgcggagacagggggctggacgcgctgaaaagcccgaagggaggaaaagaggggggcagtgagagagcggcggccccggagcccaacgggcacacacctcgccagccccgcttctagcacctgccgcctgcttgtgcctgcagccaccannnnnnnnnnnnnnnnnnnnnnnnnnnnnnnnnnnnnnnnnnnnnnnnnncctgcgggctggaggcggaggcgcggggctcccggccgggggcgaccccgccgcagcccctgcatgcaacagcgccgcctacggagcagggaagacaaggcaggcgcgaccccgccccctgctttgctctaggggagggggcgcgggggcggggcccgggcactctcattggtccgaagcagggctgtcccgcccacggactcggctggatccctcccctgagcgcgtcagcgggttattgttacaacccggggtttcccggggcaacagggatgaggcggggctcagagcacatggccccgccttctattcccgggaggaatgccccgccctctgtttctagacccttggtatttccaaatcttcgttccagaaacctggtggggtggatgatggagttcttctgttctttgtgccccgggctggggaaaaggagagggtcaagaacacctgggttctgggtcaggcttggccacaattttggcttctccatctgcaagttgtttttcgtaggcattcagagtgcctggtttaacgtgtagtagaatcaacctggagagcttgttgaaacgttttactgggccccagccagattactgggttgcggcttgagactttgcatttctgacaaggtcccaggtgatgcacccgggaccacactttgcaaaccactcttttagagtctgttgcaggctgttgccagggttgttggaacaaacacttgcctcaaatttcatcctgtttggggagaagtttctcgttcacttactatatttattgagcacctttgatgcatgtgcactgttccagctactaaggcgagagcagcaatggagacagatgaggtctctacagcataggctgtgaagaagtcaggtgttgtcagatcactgtatggcctcagtagtagagaggccagccgagcaattgggcagcccat

SEQ ID NO: 5 - DNA, 8328 bp, Bos taurus
atggatcctgaacaaagtgtcaagggcaccaagaaggctgagggaagtccccggaagcggctgaccaaaggagaggccattcagaccagtgtctcatctagcgccccgtatcctggcagcagcacagccgccactcaagagggccccctccaagagctactagccccgcagcccttcccaggcccctcgtcggttcttagggaaggctctcaggagaaaactggtcagccacagaagccccccaagaggtcctccatcgaagcctcagtccacatctcccagcttccgcagcaccctctgacaccagcattcatgtcgcctggcaaacccgagcatctcctggagggatccacatggcagctggtcgacccaatgagacctggaccctcaggctcttttgtgacccctgggctccatcctcaaagccagctcctctcttcccatgcttccatcattcctcccgaggacctgcccggcatccccaaagtctttgtgtcccgtccctcccaggtctccttgaagcccacggaagaggcacacaagaaggagaggaaaccacagaagcccggcaagtacatatgtcaatactgcagccgcccctgtgccaagcccagtgtgctccagaaacacatccgctcacacacaggcgagaggccctacccctgcggcccctgtggcttctccttcaagaccaagagtaacctctacaagcacaggaagtcccatgctcaccgtatcaaagccggcctggcctcgggaatgggtggcgagatgtatcccccagggctggagatggagaggatccctggggaagaatttgaggagcccaccgagggagaaagcacagattcggaagaggagacgggcaccacttccacacaccccacagagctctccccgaggcccaaacacccactcctgtccagcagtttatacagctccgggagccagggttccagccacgaacgctgttccttgtcccagtccagctcggccccgtcgctcgaggacccagctccctttgcggaaccctcatccgaacaccccctgagccataaacctgaagacacccacacgataaagcagaagctggccctccgcttgagcgagaggaagaaggtgatcgacgagcaggcgttcctgagcccgggcagcaaaggcagcaccgaatctgggtatttctcacgctctgagagcgctgaacagcaggtcagccccccaaacaccaacgccaggtcctatgccgagatcatcttcggcaagtgtgggaggatcgggcagcggactgccatgctgacggccacttccacccagcccctcctgcccctgtccaccgaagacaagcccagcctggtacctctgtccgtgccccggacgcaggtgattgagcatatcaccaaactcatcaccatcaatgaggccgtggtggacaccagcgagatagacagcgtgaagcccaggaggagctcactgtcgcggcggagcagcatggagtcacccaaatccagcctctaccgggagccactgtcctcccatagtgagaaagcgaagcccgaacaatcactgctgagcctccagcgcccgcccagcaccaccccccctgtgcctctgctgagaagccactcaatgccttctgccacctgcaccctcagtaccccccaccacaccttccgaggcagctactccttcgacgaccacgtcgccgactcggaagccctgagccgcagcagtcaactgtttacctcccacccccggatgctcaagcgccagccggccatcgaactgcctttgggcggagagtacagttctgaggaggcagggcccagcagcaaagacgcagcctccaagcctgcagatgaaccggaacccagggaaagcgacctcaccaaaaagaccaagaagggtttgaaaacgaaaggggtgatctatgaatgtaacatatgtggtgctcggtacaagaaaagggacaactatgaggcccataaaaagtactactgctcagagcttcagttggcaaagccagtcaccgtgggtgctcatgtatcttcggaggccgagaagagccaggccgagcatgagccctggtcccagatgatgcattacaaactggggaccaccttggaactcactccactgaggaaaaggaggaaagagaagagccttggggatgaggaggagccgcccagctttgagtccaccaagagtcagttcggcagccctgggccttcagaggctgctcggaaccttcccttggagtccagcaagtcaccagcagagccgaataagtcagtgccctccctggagggatccgcaggcttccagccaaggactcctaagccagggtccagttcagaatcagggaaggagaggagaaccacgtccaaagaaatttctgtcatccagcacaccagctcctttgagaaatctgactctctggagcagcccggcagtttggaaggggaagacaagtctgcggcccccttctcatcacccccgcctgccccgcacggacgctcggcccactccctgcagcccaggttggtccgccagcccaatattcaggttcccgaaatcctggtgaccgaggagcccgaccggccagatacagagccggagccaccccctaaggagccagagaagacagaggagttccagtggccccagcgcagccagacacttgcccagctcccagctgaaaagctgccacccaagaagaaaagactgcgcctggcagagatggcccagtcatcgggggagtccagctttgagtcctccgtgcctctgtctcgcagcccgagccaggagagcagtgtctcactgagtgggtccagccgctctgcctcctttgagagagatgaccacggaaaagccgaagccaccgggccttcatcagacacacgctccaaacccttgggcacccacatgctgaccgtccccagccaccacccgcatgcccgtgagatgcggaggtcagcctcagaacagagccccaacatctcccactccacccatatgaccgagacacgcagcaaatcctttgactatggcagcttgtccttgacaggcccttcagcaccaactccagcagctccagtggcctcagcagccccaccagagagaagaaaatgctttttggtgagacaggcttctctgaccaggcctcctgaaaccgagccagaagccacccccaagggaagacaggagagtgaggaaccaaaaccctcatccagtaaatctttggccaaaggcgcattgctcccagtttcctctgcagccacctcacacagcgggcacccaggaggcaagagccaggtgcaagacagaccagcgctgggggccactccgccctacacagaagcactgcaggtgttcccccaccccatcgctcagctcccgttgcaggagaaaccctacctgcccccgcctgtctcccttttctccttccagcacctcctacagcatgagccaggacagtcttcagagttcttccccacccaggccatgtccagcctgctctccacaccttactccatgccgccccttcctccctccttatttcaagctcccccacttcctctccaacctactgttctacacccgggccaactccacctcccccagctcatgcctcacccagccaacatcccattccgacaacccccttcatttctccccatgccttaccctgcctcctcagcactttcttctgggtttttcctgcctctgcaatcgcagttcacccttcagctccccagtgaagtggaaagccacgtgccccagatcaaaactagcctggccacactggcaacaggaacccctggcctctcccccagcacagagtacagcagtgacatccagctgcccactgtggctcccccatccagctgctcagcacccacatcagcccctccactggccctgcctgcctgtccagacaccatggtgtctctagttgtgcccgtccgcatccagaccaacatgccatcctatgggagtgccatgtacaccactctctcccagatcttggttacccaatcccaaggcagctcagcaactgtggctcttcccaagttcgaagagccctcatgcaaagggacgtctgtgtgtgggacagatgcgtatgaggtcgggcccagactggctggagtaagtgaagaacagagcagaggtttcccgactccattcttgagagtgcctgtgacattacctgaaagaaaaggcacttccctggcatcagaaagtgtcttgagcctggaggggagttcatcaacagtgggaggaagcaaacgtgtcctttcaccagctggcagccttgaacttaccatggaaacccagcagcaaaaaagggtgaaggaagaggaggcatctaaggtggatgaaaaatttgaacttgtaaaaccatgtagcgtggtgcttagcagcaccgaggatagcaagagatcggagaagtcctacttgggcagtcagggccagggcaggagggaactagaaacactctccagcctgtcctcagatccatctgacccaaaggaaattcctccccttcctcagccctcattgccccatgtgacaacctcaggatcagaggctttgaaggaatatgcccaaccatctggtaaacctcaccgaagaggattactcccatcaagtgtgaagaaagaagattccaaggaacaagctgacctccctccactggcacctcccagctcacaatctctgtcagaaacatcccccagaccagccaagttgcaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccaggggtttccactaaagctgctttgtccctcctgaggtctaagcagaaggtgagcaaagagacatacaccatggccacagctccacatcctgagacaggaaggcttgtgccatccagctcccgcaagccccgcatgacagaggttcgcctcccttcgctggtttccccggaaggacagaaagagatagctagagtggagaaagaagaggagaagagagggaagccggaggaggacgctcccgcctccaagagaggggagccggcgaggatcaaaatcttcgaaggagggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaagactgtgttcccgctccacccagcttctccacagccctcagcactgggcccggctctcccctcaccttgactggcagccctgtcattctgccctggccacgcagcacctcagggtcagctcaggctctggcagtcacctgtgagaagaaggcagactggccaggcaggaaaggcatcgtgacccacttcttctttcctggtagccgagtagaccaaggtgcctcagagggaggcctgggctctcactgctcccagagagagaggctgggtggctttgaggaggcccctccggactttgagtcttccttcttcctcctcctgatcccttccattctgtcagtgctagacgttgtgacagcagctccggtcctgggtgctagcaccggcttgtctcagttccccgaggccagcagaagggctgtggtgggtacaggcccttgcgccgatcgcctgcggacagagctggcagtttggagcagccctcaggggctgagggagggtggttggtcaaagcccaaagccgaatggggtagacacggttttcagcttatgctcttggtagaggatccacctgtgttccagatgcccatcatttccatccgcttgcctttcctccttcattccaggatggtcagatttgggtgcgtggctgtggcagagtctcccgggtgctccatgaacactgactgttggggcaggggggacacacagaatgggaaggagggaggttccacgcagtggcatctgctctctgccaggcacgctctgctgccactctacatgcgtttgttcgtccgcttctcccagcatccccatgagtatggagcacgcaaggcacctgcagtcctgagacctggctccagacggggctctgcgctagctggcaacgtggctttggctgtttggttctccgtgatggtgaacaggagctgtcccagagcatcccgtcacctcagacagtggattatctcgtccagtggcatcattagcaccaaggccaggagtcagaacagaagcaggaagaccctgggcctgaggatggccggccggcgccgcagccccgcccctgagggtgaggaggttgagcaccagcgccaccgtgtggccagacctccccagcgccccggcgcgcttcgttccacccgtcccttggctccagagaggcgggactttgtggagattgacaagctgaccccgctggtggggctgccccagcagaagtcagaccaggaggctggaaccagtgatgacccattccaggactcggaagggcgagagggcgcagaggccgtggcagagcaccagttttcagacctggacgactcggactcggactcggacctggacgaagacgaggatgaggacgaggaggagagccaggacgagccatcaggcccgtcctcggaggcgcccccacctggcccgccagccacgctgcccgcagactcctcacccgttcagggccctcagcccacagaggccacccggggcagctcggtctcagaagccgagcgctcggcacccagcagctgctccacatccagccaaagcatcctgtgcctcccccggctggcaccggccccccggggcccagtggagaaggacacaggctcggccctgagctcccaggccctgtccccaaggaggccgtggtccccaagcaaagaagcaggcagccacctaccactcaccccaaaacactcactaaccaaaagctactcgtctccccagcgacattcaccggcccgagagccactggcctcagccccgagtccgcctggctcccagacgggccctctcccctgcgggtccccgagactcgagctgtcgcctcttgccctccaccccctgggaagggaactgccacttcgagcgcgcctgccccccgaacgcaagggcgctgcagacccaggcccccccagacactcgcccaccaggagatggtctccaggccaggccgagtcaccaccacggtcagcgctgccagggaagtgggccttggcagggccgggcagccccttggcggccgagcgtggcccaggctcagggctggccccccgggctctctacccgcccgcgcctctacctcacaagcttctcggcagaagcccagcggagacctgcacctccacatggcagaaggccgagtcgccaagtccgtcctgttcacctgctcccgctcatcctctcttctcccgacccttctcggccccccatgacttccacggccacagcccggcccggacggagaacatcttcagccacctgcctctgcactcccagcgcttgacccgcgccccgtgccccctgattcccatcggcggaatccagatggtgcaggcccggccgggggcccaccctatcctgctccccgggcccagcgcggcctgggtcagcggtttctcggggggcggaagcgacctgacagggtcccgggaggcccaggagcgaggccgctggagccccaccgagagctcgtcagcctccgtgtcccccgtggccaaggtctccaaattcacactctcctcggagctggaggccagggactaccccacggagagggggaggacgagagggggcctgggcagacctcccgactgggagccccgtgcggcccaagtgcccacagagcccacgccgacgcacagcccccgcacccccccagagacctcaccccgggcacccccaggccaccgggcagagtcccggagcccccacctggagtcaccgcgggtgccggccaaccctgcggcctccgccaccccgccgctggaccgcagcagttccgtgggctgcctggccgagaccgctgctcgcttcccagcccggaggaggaacctctctggggaacccaggaccagtcagggctccccccagccctcgggaagtggggggtccgggacacctccacaccagcccgaggagcgggggccccggagcacttag

SEQ ID NO: 6 - DNA, 1247 bp, Bos taurus
aatgagctgtcgctcagcttggcagcaggacgctggcagcaggcacactccgcactccagcccagcctgagcgtgcctcaccactgtggtcgccatgcccaccgccttgtgctccatcgctctagccctgctcgtggccctgcacgaaggcaagagccaggctgctaccacccccatcccagagcaaccagcgcccttgccccgggcccgaggctcccacctgcggactcgacgttgctcctgcagctcctggctcgacaaggagtgcgtctacttttgccacctggacattatctgggtgaacactcccggacagacagctccttacggcctgggaaacccgccaagacgccggcgccgctctctgccaagacgctgtgagtgctacagtgccagggaccccgcctgtgccaccttctgccatcaaaggccctggactgatgcggtggcagtcccaggcagcgggtcccctgcagctgcgttccaggatggcaagacacaggccacagcaggagagctcctccagcggctgagggttatttctgcaaccaagatccactttgctaggcaacagcagaagccgacgagggagaccagacctacacactccaggcagaggaagagatagctctcgactctgggagaactttgggaaggaagcctgtgtggatacaggaggagaggggcatcccagagctgggagaccttccgacctgtttcctgggccagaaaacccagctgctggagcaggcacaagctctggcctcctcgccctgggagggggcctcgctcaaggcagctccgtgacaccaggaaagtcatcaggccccaggctgcagcgtggcctcccacactggctccagttcctaggccctgctgaaaggaacggcatgcggaatgtgctagcctggaggtgtcctgtctggcggctgtgaaccaggaacaacgtgcagtggcgggcactcacacccaagccagcccgagtccttccagggttgaagtcccggccgcccccgacccctcacccccgctctgtcccctccggccctcgctctccagtgtccttattctcccttcataccctcggggcactcttggtgagaagggcctgcaccacttcacctgtctgtatataacttatttgctctaagaaatttgacgattccgattatttattttaacgtatttttttagactctcaattattacctgcgaacttgtgtttgtaataaacaacaaaataatgc

SEQ ID NO: 7 - DNA, 1608 bp, Bos taurus
  unsure (410)..(460): Unknown sequence
  misc_feature (411)..(460): n is a, c, g, or t
atgggctgcccaattgctcggctggcctctctactactgaggccatacagtgatctgacaacacctgacttcttcacagcctatgctgtagagacctcatctgtctccattgctgctctcgccttagtagctggaacagtgcacatgcatcaaagcccggggcacaaagaacagaagaactccatcatccaccccaccaggtttctggaacgaagatttggaaataccaagggtctagaaacagagggcggggcattcctcccgggaatagaaggcggggccatgtgctctgagccccgcctcatccctgttgccccgggaaaccccgggttgcggcgctgttgcatgcaggggctgcggcggggtcgcccccggccgggagccccgcgcctccgcctccagcccgcaggnnnnnnnnnnnnnnnnnnnnnnnnnnnnnnnnnnnnnnnnnnnnnnnnnntggtggctgcaggcacaagcaggcggcaggtgctagaagcggggctggcgagcgcgtccagccccctgtctccgcgacctggcccatggcgccccgcggttgagccggcgccgccagggacccctcccgcgggcctccccggggcgcgcagatcccggagccgcccgcccaccctccgcggagcccccctcccctcctcgcccaagccgggcgggaccatggctgcgaagctgcgagcgcatcaggtggacgtggacccggacttcgcgccgcagagccggccgcgctcgtgtacctggcccctgccgcagcccgacttggtcggcgacgaggacggagcgctgggttcgggggtggccgagagcgccgaggactgcgggccggagcgccgggccacggccccgccgatggccccagcgccgccgctgggcgcggaggtcggaccgctgcggaaagcgaagagctctcggcggaacgcgtgggggaacctgtcctacgccgacctcatcaccaaagccatcgagagcgccccggacaagcggctcacgctctcgcagatctacgactggatggtccgttacgtgccctacttcaaggataaaggcgacagcaacagctcggccggctggaagaactccatccggcacaacctgtctctgcacacccggtttatccgcgtggccggccccgtgcttggtgcacccggggagctggcgctggcgggcgctgccggcacctaccctggcaaaggggtggccccgtacgcgccgccggcgccctcgcgcagtgccttagcccaccccatcagccttatgacgctgcccggcgaggcgggcgcgacgggtctggcgccgccgggacacgcggccgtcttcgggggaccccccggcggcctcctgctagacgcgctgcccgggccgtacgccgccgccgccgccgggccgctgggtgccgcgcccgaccgcttcccggccgacctggacctcgacatgttcagcgggagcctcgagtgcgacgtcgagtccatcatcctcaacgacttcatggacagcgacgaaatggacttcaacttcgactcggccctgccgccgccgccgcccggcctggccggagccccgccccccaaccagagctgggtgccaggctga

SEQ ID NO: 8 - protein, 2775 aa, Bos taurus
MDPEQSVKGTKKAEGSPRKRLTKGEAIQTSVSSSAPYPGSSTAATQEGPLQELLAPQPFPGPSSVLREGSQEKTGQPQKPPKRSSIEASVHISQLPQHPLTPAFMSPGKPEHLLEGSTWQLVDPMRPGPSGSFVTPGLHPQSQLLSSHASIIPPEDLPGIPKVFVSRPSQVSLKPTEEAHKKERKPQKPGKYICQYCSRPCAKPSVLQKHIRSHTGERPYPCGPCGFSFKTKSNLYKHRKSHAHRIKAGLASGMGGEMYPPGLEMERIPGEEFEEPTEGESTDSEEETGTTSTHPTELSPRPKHPLLSSSLYSSGSQGSSHERCSLSQSSSAPSLEDPAPFAEPSSEHPLSHKPEDTHTIKQKLALRLSERKKVIDEQAFLSPGSKGSTESGYFSRSESAEQQVSPPNTNARSYAEIIFGKCGRIGQRTAMLTATSTQPLLPLSTEDKPSLVPLSVPRTQVIEHITKLITINEAVVDTSEIDSVKPRRSSLSRRSSMESPKSSLYREPLSSHSEKAKPEQSLLSLQRPPSTTPPVPLLRSHSMPSATCTLSTPHHTFRGSYSFDDHVADSEALSRSSQLFTSHPRMLKRQPAIELPLGGEYSSEEAGPSSKDAASKPADEPEPRESDLTKKTKKGLKTKGVIYECNICGARYKKRDNYEAHKKYYCSELQLAKPVTVGAHVSSEAEKSQAEHEPWSQMMHYKLGTTLELTPLRKRRKEKSLGDEEEPPSFESTKSQFGSPGPSEAARNLPLESSKSPAEPNKSVPSLEGSAGFQPRTPKPGSSSESGKERRTTSKEISVIQHTSSFEKSDSLEQPGSLEGEDKSAAPFSSPPPAPHGRSAHSLQPRLVRQPNIQVPEILVTEEPDRPDTEPEPPPKEPEKTEEFQWPQRSQTLAQLPAEKLPPKKKRLRLAEMAQSSGESSFESSVPLSRSPSQESSVSLSGSSRSASFERDDHGKAEATGPSSDTRSKPLGTHMLTVPSHHPHAREMRRSASEQSPNISHSTHMTETRSKSFDYGSLSLTGPSAPTPAAPVASAAPPERRKCFLVRQASLTRPPETEPEATPKGRQESEEPKPSSSKSLAKGALLPVSSAATSHSGHPGGKSQVQDRPALGATPPYTEALQVFPHPIAQLPLQEKPYLPPPVSLFSFQHLLQHEPGQSSEFFPTQAMSSLLSTPYSMPPLPPSLFQAPPLPLQPTVLHPGQLHLPQLMPHPANIPFRQPPSFLPMPYPASSALSSGFFLPLQSQFTLQLPSEVESHVPQIKTSLATLATGTPGLSPSTEYSSDIQLPTVAPPSSCSAPTSAPPLALPACPDTMVSLVVPVRIQTNMPSYGSAMYTTLSQILVTQSQGSSATVALPKFEEPSCKGTSVCGTDAYEVGPRLAGVSEEQSRGFPTPFLRVPVTLPERKGTSLASESVLSLEGSSSTVGGSKRVLSPAGSLELTMETQQQKRVKEEEASKVDEKFELVKPCSVVLSSTEDSKRSEKSYLGSQGQGRRELETLSSLSSDPSDPKEIPPLPQPSLPHVTTSGSEALKEYAQPSGKPHRRGLLPSSVKKEDSKEQADLPPLAPPSSQSLSETSPRPAKLQEGTDSKKVLQFPSLHTTTNVSWCYLNYIKPNHIQHADRRSSVYAGWCISLYNPNLPGVSTKAALSLLRSKQKVSKETYTMATAPHPETGRLVPSSSRKPRMTEVRLPSLVSPEGQKEIARVEKEEEKRGKPEEDAPASKRGEPARIKIFEGGYKSNEEYVYVRGRGRGKYVCEECGIRCKKPSMLKKHIRTHTDVRPYVCKHCHFAFKTKDCVPAPPSFSTALSTGPGSPLTLTGSPVILPWPRSTSGSAQALAVTCEKKADWPGRKGIVTHFFFPGSRVDQGASEGGLGSHCSQRERLGGFEEAPPDFESSFFLLLIPSILSVLDVVTAAPVLGASTGLSQFPEASRRAVVGTGPCADRLRTELAVWSSPQGLREGGWSKPKAEWGRHGFQLMLLVEDPPVFQMPIISIRLPFLLHSRMVRFGCVAVAESPGCSMNTDCWGRGDTQNGKEGGSTQWHLLSARHALLPLYMRLFVRFSQHPHEYGARKAPAVLRPGSRRGSALAGNVALAVWFSVMVNRSCPRASRHLRQWIISSSGIISTKARSQNRSRKTLGLRMAGRRRSPAPEGEEVEHQRHRVARPPQRPGALRSTRPLAPERRDFVEIDKLTPLVGLPQQKSDQEAGTSDDPFQDSEGREGAEAVAEHQFSDLDDSDSDSDLDEDEDEDEEESQDEPSGPSSEAPPPGPPATLPADSSPVQGPQPTEATRGSSVSEAERSAPSSCSTSSQSILCLPRLAPAPRGPVEKDTGSALSSQALSPRRPWSPSKEAGSHLPLTPKHSLTKSYSSPQRHSPAREPLASAPSPPGSQTGPLPCGSPRLELSPLALHPLGRELPLRARLPPERKGAADPGPPRHSPTRRWSPGQAESPPRSALPGKWALAGPGSPLAAERGPGSGLAPRALYPPAPLPHKLLGRSPAETCTSTWQKAESPSPSCSPAPAHPLFSRPFSAPHDFHGHSPARTENIFSHLPLHSQRLTRAPCPLIPIGGIQMVQARPGAHPILLPGPSAAWVSGFSGGGSDLTGSREAQERGRWSPTESSSASVSPVAKVSKFTLSSELEARDYPTERGRTRGGLGRPPDWEPRAAQVPTEPTPTHSPRTPPETSPRAPPGHRAESRSPHLESPRVPANPAASATPPLDRSSSVGCLAETAARFPARRRNLSGEPRTSQGSPQPSGSGGSGTPPHQPEERGPRST

SEQ ID NO: 9 - protein, 177 aa, Bos taurus
MPTALCSIALALLVALHEGKSQAATTPIPEQPAPLPRARGSHLRTRRCSCSSWLDKECVYFCHLDIIWVNTPGQTAPYGLGNPPRRRRRSLPRRCECYSARDPACATFCHQRPWTDAVAVPGSGSPAAAFQDGKTQATAGELLQRLRVISATKIHFARQQQKPTRETRPTHSRQRKR

SEQ ID NO: 10 - protein, 535 aa, Bos taurus
  misc_feature (138)..(154): Xaa can be any naturally occurring amino acid
MGCPIARLASLLLRPYSDLTTPDFFTAYAVETSSVSIAALALVAGTVHMHQSPGHKEQKNSIIHPTRFLERRFGNTKGLETEGGAFLPGIEGGAMCSEPRLIPVAPGNPGLRRCCMQGLRRGRPRPGAPRLRLQPAGXXXXXXXXXXXXXXXXXVAAGTSRRQVLEAGLASASSPLSPRPGPWRPAVEPAPPGTPPAGLPGARRSRSRPPTLRGAPLPSSPKPGGTMAAKLRAHQVDVDPDFAPQSRPRSCTWPLPQPDLVGDEDGALGSGVAESAEDCGPERRATAPPMAPAPPLGAEVGPLRKAKSSRRNAWGNLSYADLITKAIESAPDKRLTLSQIYDWMVRYVPYFKDKGDSNSSAGWKNSIRHNLSLHTRFIRVAGPVLGAPGELALAGAAGTYPGKGVAPYAPPAPSRSALAHPISLMTLPGEAGATGLAPPGHAAVFGGPPGGLLLDALPGPYAAAAAGPLGAAPDRFPADLDLDMFSGSLECDVESIILNDFMDSDEMDFNFDSALPPPPPGLAGAPPPNQSWVPG

SEQ ID NO: 11 - DNA, 121 bp, Bos taurus
taaaaagacaagagacatccagtagaggcaacagggtgcccaggcctgggcctcaggagamaagtttgggctggaggtggactctagcaatcattggctagagatggaaattcagcctata

SEQ ID NO: 12 - DNA, 121 bp, Bos taurus
cctgtaggatgcacactgaactgagctgtggatgaagcccagagaaggtgaataattgackcaaggtcacaggcttgacagggtgacactgaagtacaaactttcttgtccggctctgctc

SEQ ID NO: 13 - DNA, 121 bp, Bos taurus
aggggagaagacagacagaggatacccagcaatgccagctgggaggctggctccaccaccsggggctgctgttgtctctgatccagcttttctagtctggtgggatggggtaacatctgtg

SEQ ID NO: 14 - DNA, 121 bp, Bos taurus
ctaatctcttattaatggtagctataatacttttatatttaggactttcagaaaaacctgrtcaaagtcaacaatttcagcattatcttggggaaactgtgtgtgaatgagctccactgcc

SEQ ID NO: 15 - DNA, 121 bp, Bos taurus
ggggatttttcagtaagaggttaataaccagtgaggtaaacatgtataacaacctgcttayatgcacactgggaagtgtcatgaacctttctcacctccatgctgagtttccagagaacca

SEQ ID NO: 16 - DNA, 121 bp, Bos taurus
atactgtcagagcaggcatctcagaatcagacactttacctgatccctctcttacagagtstgaaacagctttcaagtattgggaagaggtagatgctccccataccaaaagcatccctgc

SEQ ID NO: 17 - DNA, 121 bp, Bos taurus
aaaaagtagagtgatgacagacccattatataattgaaacatgttataaagcctcaacaartaacacatgaataagaagtccagaaatggggtcagttacataaaggaatttaaaatttac

SEQ ID NO: 18 - DNA, 121 bp, Bos taurus
gatgagatgcatcgaaaactgcaatgccggcagctagcactggtcaacagaaagggcccarttctccatgctaatgcccgattgcacaatcaatgcttcccaagttgaaggaattaggcta

SEQ ID NO: 19 - DNA, 121 bp, Bos taurus
atctgcttggatcttctcattagcgaattccaagaagatgagccagatcagcccagggacygtgaagatcccagaggaggacacacactcccatcctgtgagcatttttcttatgtgtcaa

SEQ ID NO: 20 - DNA, 121 bp, Bos taurus
tctgagtgttcattgctgcaccgcctctccaagctcccaagggcatctctctacgtaataktaatgcctggccaggtcccatccattctgacagacaaaggacarrcgctactttacattt

SEQ ID NO: 21 - DNA, 121 bp, Bos taurus
acctgatgactattaagaaattaacacgtaatctacatgactggccagcagccccactcarggagttccttactcctaagcagttcttaggagttagaactcttcagttcagttcagttgc

SEQ ID NO: 22 - DNA, 121 bp, Bos taurus
aataacttaaaaattattgaagtgtagtttatgtacaatgtaatgttaatttcatatgtayggcaaaaccactcagttatacagatatgtatacatgtatactagaaaagaaccattctta

SEQ ID NO: 23 - DNA, 121 bp, Bos taurus
attctctctggtcatggctattcattcgtcccttcctacctacacttgccctgttccaggytggccatccttctctccatctgcccatttcctctggaaaagcaaccaccttgcagagaag

SEQ ID NO: 24 - DNA, 121 bp, Bos taurus
acactttccagttttagatatgctcatatagcaatgcttccatatctaagctttagtctcytgaagggtttgttgttgttgttcaatcacctagtcatgtccaactctgcaatcccatgga

SEQ ID NO: 25 - DNA, 121 bp, Bos taurus
atgtcttgagtaatacttttacttgttcagaaagtttatttgtttattttccataatgtaygtactgccagaatgttactcagtatactcttgtatctatcaaactttcagcagttaggtc

SEQ ID NO: 26 - DNA, 121 bp, Bos taurus
ggcccacgagtcctagccaggtggccttgccttgtggccctgttgagttgctttgatcacrtgacttgttcatacgtggctggtccataggttggagcagatttcacacacaaacccctga

SEQ ID NO: 27 - DNA, 121 bp, Bos taurus
agggagggtttggcactggcaaggggtccatggaacatggacagaatgaagctctgggagkgaggggcagaagcacatgaggaggtcaagcttcaggcccttcaccttgacacaatgggaa

SEQ ID NO: 28 - DNA, 121 bp, Bos taurus
caaagatttttggtctgatataaatgtgtgtcttctttttaggcctgtgatttttcaatgyaaaacaaaatttaaaacttcttataatagtatttagcaggagaaaagaaggagggaacta

SEQ ID NO: 29 - DNA, 121 bp, Bos taurus
atgttttgccctttgatattcacaaggcttccccatcctatctttctggcctctgataccktcttaccaccaccctccctttattctctgtccctactcagctttatttttttccacaggg

SEQ ID NO: 30 - DNA, 121 bp, Bos taurus
aaatggcatgcttcatgaagactcggtgcacggacctgatggaatgctgtgccacctccaytcttaggcctcgccaagaggcccccagtttctagtaggaaacaggtattaataatgcgag

SEQ ID NO: 31 - DNA, 121 bp, Bos taurus
accagatatttggtaatttgttgaatgaattaaatgcaaatggttttgaaaaaataaaagrtattattgttatcattgtctgttgtacctgttttcttcctttaaaagtcttggaaaattc

SEQ ID NO: 32 - DNA, 121 bp, Bos taurus
catcccatggaataaaaaagaatacagctttacacaaaactggttaatgataacttgcatrtgagctcagtcacttcagtcgtgtccgattctgcgcaaccccatggactgtagcctgcca

SEQ ID NO: 33 - DNA, 121 bp, Bos taurus
aacaaatgaattaagagatatttggttgccatgaatgttatgtggaaacaagacaactggygtgataaggaatctgggaaatctgcttacttttggtaccgaaagctgagctgacttaacc

SEQ ID NO: 34 - DNA, 121 bp, Bos taurus
aagattatactaatttttgtaaaaaggagattatagtatgattaaacattaacattcaaaygctgatttaaattgtgcatatatttttctcatttcttattgaatttatgatcattgatga

SEQ ID NO: 35 - DNA, 121 bp, Bos taurus
cgcccttttcctgtaacaagaggctagaattttccacttttattgccttggagaagaaacraagcagatgtctgcaggaaacaaaggaatcaaatttgtagtatttaattgccaaaggccc

SEQ ID NO: 36 - DNA, 121 bp, Bos taurus
tcagggtaggaaagctttatggtataattcatgctccaaaagctccccataggatcaggtkaacccacatcttggcctgtcctgttgtgcctcccttgttccatttcaggtttctcctgaa

SEQ ID NO: 37 - DNA, 121 bp, Bos taurus
aagatcttggcatgctttcaattcctcaaggagataaggaaagaaaaataaacagcactayagaaaaatatgaattagtcctggaaatggcaggtatctctaggccttacatcacattagc

SEQ ID NO: 38 - DNA, 121 bp, Bos taurus
actacttcagccttactcttttagaattgtagtcagaaaagattgtgagtcgtttggaaaygagcacttagcccatttctatcgcacgctggaaactatgaacattttcactgcacgtaca

SEQ ID NO: 39 - DNA, 121 bp, Bos taurus
ctgcttggaaaattcataccaaaagcagtaacaggaaatgtgcagagggttttctgtgtgyccagcacagtgtaagtaagcttaataatccctattttcttaattcattccacacaaagga

SEQ ID NO: 40 - DNA, 121 bp, Bos taurus
caaagaggtctgagtttctgatggcaattcataaagtgacactgaattccaagagtaaatrtctgaaaaaagccagagccatctaaatagaacagcagagagaggaggacagagaaagcag

SEQ ID NO: 41 - DNA, 121 bp, Bos taurus
caggccacctgaattggatctttgcttctctactttttagtagtaactttggtaagttacrtaacctcccagggcctcagatttctcacctgtaaagtgggagtaatgtgcacacctggta

SEQ ID NO: 42 - DNA, 121 bp, Bos taurus
aaatggcttttttacatgaagcaacatgtaccaggacctctattattcactacaaagaaartagtgaataatgctccatgtctcagaattcttgtgtataaaatgagaattatcaaatact

SEQ ID NO: 43 - DNA, 121 bp, Bos taurus
atagggagagagttatactcctgcaaaggactgtttaccccccttcaaaaatgtgcattartcattagctaagtgacagtgggtagatggaaaggtgactttattcagtgatatttttcta

SEQ ID NO: 44 - DNA, 121 bp, Bos taurus
cttatacataaagttcaattttttttatatggtataaaatgccctttaagatctggctcartgtcttcttatcaacctcatttttcacttcccatttttttcagttctgcacacagtccca

SEQ ID NO: 45 - DNA, 235204 bp, Bos taurus
  misc_feature (20401)..(20450): n is a, c, g, or t
  misc_feature (75128)..(75177): n is a, c, g, or t
  unsure (80761)..(80822): sequence is unknown
  misc_feature (80772)..(80821): n is a, c, g, or t
  unsure (132088)..(132139): sequence is unknown
  misc_feature (132089)..(132138): n is a, c, g, or t
  unsure (139288)..(145041): sequence is unknown
  misc_feature (139289)..(145040): n is a, c, g, or t
  unsure (147194)..(147390): sequence is unknown
  misc_feature (147195)..(147389): n is a, c, g, or t
  unsure (169640)..(169701): sequence is unknown
  misc_feature (169651)..(169700): n is a, c, g, or t
  unsure (172768)..(172819): sequence is unknown
  misc_feature (172769)..(172818): n is a, c, g, or t
  unsure (178861)..(179100): sequence is unknown
  misc_feature (178862)..(179099): n is a, c, g, or t
  unsure (183978)..(184029): sequence is unknown
  misc_feature (183979)..(184028): n is a, c, g, or t
  misc_feature (207968)..(208303): n is a, c, g, or t
  unsure (207969)..(208321): sequence is unknown
  unsure (220850)..(220901): sequence is unknown
  misc_feature (220851)..(220900): n is a, c, g, or t
  unsure (224061)..(224244): sequence is unknown
  misc_feature (224062)..(224243): n is a, c, g, or t
  unsure (227962)..(228013): sequence is unknown
  misc_feature (227963)..(228012): n is a, c, g, or t
gtggccagcacctcatgttcgttctctgggtttgctttttcacgtccagtgcctgatcatggccaggttcaccgaactggaggcagatgagatctgacaagttttcatagacatggcatttctgaaggataacagagctagtggtggcaacagtctgaactaaatgtatgagctctggaagctttcagcagccacatctctcaccctgcctccctctatgcagtgcccgtcccttctatcatgctaagaactctccaacgcattcaaagcttttaaccaaagagaagatgagatgtgatcagccagcaggagctcaagctgtccagggaccattcctgcttgtggatgtgccgtgaccccagccccatcctccagtggtgaggaccctcatttggctgcagcttcggtcagtcatttaaggtgacaggttgttgaaaggctacctgtaaacgtaaagctcacatggtccagtctgccaggcctccagggaagccttgttttctggttttcaagtgcaaaaactcaaatctctttattcttaaattcagaatttcttctaaatctgttcaccatcttgcacctctatcatcctgatataaatctgacggtttggttaacttcactgaggcttttattgaccctgcattttctttattgggtcttgatctttcatcacattgatttccatttcacattgatttcaaaactgtctcacatggactgctagagtatgtggtacaaactccctgtctggcggatcatgtgttgtaggaggaacaaatgctgccttcagccatgtattcagtatccaagtatggatgctggaatgcttcatgttccgagtcagcaattccatcttcatcactggaatttggtcctcaccatcatcctcttgcctatggtcgcagagggcttccaagggcttcagcatcctcatcagcatgttctgaattcctttgtaaatttgcctgtggctggggtggaggaggggatgatggagcttcagccctaccgcttcctgtatgagctggtcagtatatgccggggatggacattccactggcatcttagccccaaaccatggcttcccctttgagttgggagggaaggacatctctatgcttcacagtctatcaaaattggggacatttgttttccttacgttattttaatcttttgtccgtaccacacagcatgtgagatcttagttttctgaccagaggtcgaacccaggcccccttcattgacagcacagagtcttaagcactgcaccaccagggaagtccctcctcatattgttgaaaattaaacctaactgtgatgagcgctctcaacgcagagcgctagacagcagatcagatacagattgatccctgctatatgctaagcacagttcaaagcacataacctagactaacaaagttaacctcacaataaccccgtgagtatacatgttactttcaataatttaaaaaactgaaacagaccatacacacaaatggagaaggcaatggcacccactccagtgctcctgcctggaaaatcccatggatggaggcgcctggtgggctgcagtccatggggtcacaaagagtcggacacgactgagagacttcactttcacttttcgctttcatgcactgaagaaggaaatggcaacccactccagtgttcttgcctggagaatcccagggacgggggagcctggtgggctgccgtctatggggtcgcacagagtcggacacgactgaagcgacttagcagcagcaaacacacaaaagcaatccaagtcataaaagtacagtctatgagttatgacaaaatgatgtataattttgtataattatacaaattatgtccagttacccccaagtcaagaaacagtacaggatcctcattttacagatgaagcaactgaggcacagagaggttaagtaacctgcccaggatcacacagctaagggttcagccaagaggtataataataaagccataccacagccacagcgagctgctctgagtcgtcagccccaaccctgccacggggcaggaacatgctcagggccacacagctggtggcaatgaggcaggatttgaaccccagcagtctgaccctaccaaccccccaacccatgcctaaccactgcactctgcagcatcccaaacaaagcaagtggatcccaacttcaccacactgtagctgtgcaacctcagacaggtcctttcaccctccgagccatgaccacatccttccttcctgttttctcaccttatccccctgcgggctgtttgaggctggaactccaggttggatactggccatttagattccaactaggcccacctcaaatccagcctctctaccataggaatctattttgctcaaaacctgacttttagtctgtgcttacactatccatgctggggggctcactaccacccaagcttgctttgctccaagtttgtagctctggggttggaatattctattttaaaatgaacccagtccttcctacctgtcttggttttgcctgtggactgaaccacctcccaggagactgcattaattgtacttgtgacccgaggaatttgtggacaaatttctatgagcctggtttctcctctactcccagctggtagagagcagatctgctcagaacaagagccaagaaggtgcctgccatcatgggacaactagaatggaactctcttctcttcccctgtaagatttgagtctgtaagtctggggcccaaatacacagcccccttgtgtgctctgcaggttgaagcagctggtaatgccagctggccccttcttgaaaaggggtctgatgcgttgcagtagctatcctgctgccttcaaatatttgggaaagccttgctgtcattcagttcagttcagttcagttcagtctctcagtcatgtccaactcttttcaaccccatgaatcacagcacaccaggcctccctgtccatcaccaactcctggagttcactcaaactcatgtccatcgagtcagtgatgccatccagccatctcatcctctgtcgaccccttctcctcctgcccccaatccctcccaacatcagagtcttttccaatgagtcaactcttcgtatgaggtagccaaagtattggagtttcagcctcagcatcagtccttccaaagaacacccaggacagatctccttcagcatggactggttggatctccttgcagtccaagggactctcaagagtcttctccaacaccacagttcaaaagcatcaattcttcggtgctcagctttcttcacagtccaactctcacatccatacatgagtactggaaaaaccatagctttgactagatggacctttgttggcaaagtaatgtctctgcttttgaatatactatctaggttggtcataactttccttccaaagagtaagtgtcttttaatttcatggctgcaatcagcatccgcagtgattttggagccccccaaaataaagtctgacatgtttccactgtttccccatctatttgccatgaagtgatgggaccagatgccatgatcttagttttctgaatgctgagctttaagccaactttttcactctcctctttcactttcatcaagaggctttttagttccttttcactttctgccataagggtagtgtcatctgtgtatctgaagttattgctatttctcctggcaatattgattccagcttgtgcttcttccagcccaatgtttctcatgatgtactgtgcatcatgggatgcagggtatacccttaaataagcagggtgacaatatacagccttgacatactccttttcctatttggaaccagtctgttgttccatgtccagttctaactgttgcttcctgacctgcatacaggtttctcaagatgcaggtcaggtgctctggtattcccatctctttcagaattttccacagtttattgtgatccacacagtcaaaggctttggcatagtcaataaagcagaaatagatgtttttctggaactctcttgctttttccatgatccagcagatgttggcaatttgctgtcattgcctcacagctattccccagcatagagacacctgacattcattgtgggaatctgatgtagttcacagccttttcttatttgcatcttgaggcatacgaatctctgagcattgaggaaaccctgaggttccccagagcatggtggcatggcgcctcatagccattggcctgtaggcattgatcaggcacccaatgtctacacatatttcatcagctgctatcacagatggccttggtcaggctcccctcaactcgcccttgcatgccagcctcagggggtgcttccagagcacggctgtaagagaacactgtcaccatcccctctgacacaggccaggcttctgtaccagcccctgaggtttgtctaagccagcttccatccctgcttcttgccatatagaattgccgtatagaatcatgccaaggcttgattataattcctataatacatgcctaacactccacaaatgctagctgtttctttttccctaacaaaaaaaaacacctctgatcctggctgacgttctttttgtgctttttagtaaagagtaaaacatgcgtccagtctccaggatctggtcacttccccattcttgacctgtttcctgtctggggaacaaggaagtgaagctgggagaaccagccaaccatagtcctgcatcaggctggactggctccagtcacaacagggggcctctgggtgctctgggccatcccatcttaagagggacaacctggaggggttgggaaggtctggggaggaatctggaatccatcttgagcacatctgtttgaggcctggagcagaggaatcttggctagagcagcatcctttagggaccctcatgtgcaagagggcttgcactgaactgtgctcagactacagaaggtcaactttagcttagttaaggggagctctgcccagagtggaaggtgctgcctgggacaccatgagaccccaggtgccagaggtggacgcgcccaaggaggggtgtggatgggctgccctaagaatgacctcatcagagggtgcacgaggcccctcccacccaggaagttgaaggtttttaggtccttcccagcatgaatgtgctttaacagtgattttcaaattgattttaaattcacagaactcttttttacaaatagattcctattctgaaaaacagctcaatgcaatgagggacatggggacccagaaccctgctgctcagcctccccttccataaatcctgagcacagcgtgaaaggccctgcaagtcagggcctgctaaaggctggggcacccccatgtaaatgggcacctttaagaagtgcaccccttgttggtagtttcacttctctgaacacaacaggcccagtttctggcatcctgcctccctccctaatgtcactgtctggtcggaaacagggccttggctgcattctttgggcctgagctggtttcagcccaggctgggtgcctgctcggtggttcttaggcttctgcactcagtcattcattgcacagtgtctcaagtcatcgtattgattcctttagaataaaagccacctcctctttttagacctgagtgctgtgtgtcagacccctgagctgctgtcttcagggcagctgatgctgtttactgttgtccccctagaatgacaaatcacaccagaaaaattgagaaaacagcccaaatggcacagatgcaagcctgcaaaatagacacgggctggcctccgtggtgggagtgcttctgaaaagtgtaaagcaggcttcttgacctgcctcccctcctgtctctgtcaggcagcctcgactcctggaatctgtgtcctctttcctctcgcccttgcctctgccccatcttgggctccatacaattacaccaccatcccccagcttccgggcctcccagcccactccatccccaaccctgcaccagatggggactcccaaaacaggagtctccccagtcagacccgattcacccccaaaagccacctaagacccacccgatcctccatggtactttgtgagttgtctgtgttacaggttctctgtctttattttaccatcttttaagtacctgttattcattctggagaccaaggtcagagtcttatttagctttgcttttctgggccaggctcagaccaggcctttgtaagtattattgagtaaatacacagaatactgcttaaaatagaccctgctctgtcaggctctgagcctaggcttgtattacacatgtgccaaggaattcttggcacagcaggtctgtccctggaccccgcattaaatgccccccacccctactggctcagtggtaaagaatccgcctgccaatacaggagaccctcaatcaatccctggagaaggaaatgacaacccactccagtgttcttgtctgggaaaccccatggacagaggagcctggcagttcatagtccatggggtcgcagaagagtcagacatgactaagcaactaaacaacaaccaccccagatgtagtgatgtgacatgatttctgcagaaccctgacaaaatgagagtccgtaatgtgccccgaacccggtgtgaacttgccccatgacccacagctcagcttccccagtatacttgtcaccaaagggtgtgttcccaacctcttggcaacagaatatttttagcagatacacaggtcagtgccacctggcacttgctcctctttccacagacatcccttcctttctgagcctcacccagagagcaacgagtcactgcaaatgagctggtgggctcactgtggccggacctccggggggccagtgaccgccgggaaccaaccctgagcctcacttcatgggacacaggctgcccgcaaacatgggtcttctcagaggaacagtgagcacatttctggtcgcatctccctctccttttgcatgatcatacccaggctgtgtgcccctgggggaaagcatatttggctacaagatcataatacaatcagaattttgacaagactttaaaatatccaaatctggaggagagttgagaatttttagaataaaatattaacaatatatgaaaacatcaataatatacattcagaacagcctcctcagagctcaaattaggaaggtcacaccaaggtcattgagtttatccccctcattcaagagaaaaatgaagcttggtggaaagagaagtcatgggtttaaaggtcaagacaggtatctactagccacatgaccttggggaatttactttgagccacaagtttagctctgagctaaatctgcctctcctattttgcttgcctgaaactgtttttttttaaagaggagatttttaagtcttaaaatttcatagcaacatgtgaccttagttcaaattctgattctgtgaacctgctgtctgtgacctcaggcaggttactgagcctctctgtgactccattttcttatgtatataggaggatgattaaattccctgtgtcacggggctaccttgtggtttaaatgaggaaaggtatgcaaagcatttaaaatagtgttcggtaccaagtaggagctatctaagggtatgctaatattattattattttaaatctggattggtggttttcttgaaaacccggaagatctgacagcctcatacaacacttggctggaaaggtgtagccactccccctttagagagactgtgccctgccttctagctctcaacctctccctcctccttgtacctcctctgtttcactcagcgggtgtggccagctcaccgctcctccccaacacgctccctcccttctagggccctgagccccctgtttggtcaggaagcagtatttctgtttattggataaatttagaggataaacagggcttccctggtggcttagacagtgacgaatctgcctgtaatgcatatgacccaggtttgatccctgggtcaggaagattccctggagtagggaatggcaacccagtccagtattcttgcccctctgtctctgagctgccataaccactcattctcttgctccagggcctcccggcctggcttctgggtgaacagcactagtggcaggccgctcactacctcacagggcagcttcactgctgagtcttcatcttatgcagggtccaagaacaacagctcacctaccaccttgcctgagatgccatttaatttccactgcatcccctcttctggaatccagagcagagggatatgccatctcctttcagagctgtgcgctgagttcccaagtgcttgggcaaaacttcaggtttcagaaatgcctacaaaaaggctggagtcactacccaaggggtcacgtgctgaatggtcagagtcaggcagctcagcatctccagtggcaggactggaggggaagctgctgaaggcagggggtcagactgcgtcatccgtaagagcactggggtcagagctgggttccggttcctgcttcaccactttcgagctgcctttgtggctttgggcaagacacacaacctctctatttctgtttccttctctgtcagatgaaaataataagactcccgtgatgaagggattgtgcaagattctccttcttttcctttgaatccgtgagtctcagagctgcagcataagaatgaaaacagacccagaagattctggcagctccactcccctcctgggagcctcactcccctcctgacccagggcagtggaacagggaagctgcttccaggcgagggttcgggacccctggtgctgagtagtgacctcaggccctcacagccctgggcctcaggcagtcaagctcaaggtctctctaagacatttcggaatccacagaaacagctttttttttttttttttaagacaaaaccaagcattttccagactggctgacatccctggctcgtcagagcagcaaaagacaggcaggtggtggggctcagacagccgtgagtcagctgtacccaggctaggcacagatagggggccgggagggcacttcctctgcggctgaagggctgcctcagctggagggtggaggggccagcagacctgggaagcaggaccatgcccctgggcgccgcaccatgcatttctggcttccttccctggctctttgcagggcatttctctgcagctgtcaacaccctcagtcccacccagcgctggcagcctttcaggagggctgcagaagagcagtgttcttctctgtctgcagtcctacaggcccctgggcaccccagagaaggaaggtgctaaggaaaccttggtcagcatcacctaaaagcatccaggcagcgtctgtgcaggggcagggggacaaagtggaaaagtcgctggtggtgtgatcttgtccacatcacttgaactccctgggccttggttcacatttgtataaaatgggaacagtggccaagagctggtgggagggctgaatgacctcaagcctgtggcagtgactggtacacctaagggcaaagtttgactgttttcgctggaagggaagtgatttttccaaggttgctcagcacgttcacacaggagccaggactcagatccagctctcatgctgacctctccatgcacagagaggttcctaccagaaagtggggagcgttctggcagccagtccaccgtggttgggagggactggctgtgtgccgcgtccgtggggagcccacagtgtcaggctgaacttgtgctcagggactcgtgagagcatcttggctgagggtctctagcagacatgaggaaagaaggccctggcttggctcccgtctgtccagcaatgcctaccgagcacttgcagggcatcaggcactgtgctaggcccgggggatgcaccagtggatgaggcagacgtgtcccccctccatggggctaacagggaccaccctgtgagaggccacgacagtacacacagctcgacaggtgccgtgaaggaggagtgggtgggacccccaggcccacgggtgtgtgagagagggctctgaaggaagggacccattggcagagccctgaaggagacagacagactgtagcccgcggtggctggcgggggtcgggggagggagtgcagggggaggtggaagaccagaggaaagggactcagaggcacgggatgacattcggtgtggttggcggagaagtgccgtgaagggaagagctggaggggtagctggaccaggaggtgccccggggccttcagcacccgctgagtgaggggcagggctttaccagagcgcagtgggaggagcatttgagtgggcccttgggctgtgaggagcggccagatgggcggtatttggggagagtcccctctggctgtcttgtgaagacagcagggtaggagagaggatggtctgccctgtggccgcccggaggtgggcctccctggaacacatgtcgcatgtggtgttgacgggccgtggtgatggactgaccgacaagactgaaggatgtggaggcaccaaggatgctggcctggccaccaccgggtgtgcatgccatttactgacgcggggacccaggaggcagtggtacaggtggggggcatggaaacaggattctgggaacgtgggttgcaaggtgcctgaagaccaccgggaagacgccaagagggcagctggatgtacagcagagcggtcagagctggagagacaagaggagtcttcagcatccagggggaaagtcaggtgtgtgtggaggagctcacctggaggcaggtgtgaggggagaagcatgcaggttggtacccgcagggagggtgggggtgcagagaaggaacttgccgaggagacccggtcaccaagccagcaggtatctccagatggtaggcaacggggctcacagggtaaaaccactgtcactcagatttagcagcccgtgacattgacaggaacagtcagcaggggagctgggctggggtggcgaggagacgtgactgccagcaggacggccctttccagacttgggctgagaagggaagcagatggagtggtcgctggagccagctgaggtctggcgggcgggggctgctgttgcttggtaccaagaggactgagcccgcgcgcacagtggtgggatgtgtccaaaggtggaggcctgaagctgcaggggaaggggtgggatcttatagggagacccctataaggggccatccaacctccagcacagactggagggactgagcctgggctgggaaggggaggagggcccagccgacaccggacagctgccccacacctgtccctggacttggtcctttgggaaccaccaagctgcacaaccccagtactggcctttgaggagcagagaagtcagaggctccaggctggccaaccagaactgccctctccaagtcctgggagcccaggggccacccttcccctgctctccatcacctgactgcctcctcctctcacctcttttctgtggctccccaatcacattctctcctggttccttatcaggatctctctgcttgggggtggcttttggcaccatccttctacccacccttacctttgggtgcttcctgggccctctcactatcctttttctgttttcatactctcttgagtagtcacctgcctcctcacaaagctgcaagtcccatcctgagtcccatggaattctggttgtgtgtggacattccttcaattctctcatgagcatctcacattcagtagttaaggactagactccggtaccatttctctctaagccgtggctggtaccacctgaactagctaagttgaaatctttgttcctcctgcctggtgccccctgtatcatccagacagccaccaggatttgtagattctacatccagaaggcttcgaatccctgtcgtacaacacgtgtgtcttgaacccagactgtttctcctcttgcagaccgttccccatggcaccaaggaagtatcttctgttgagactttatgtttacctttaagacaactttaaccaagtctccatggcattcaaggctgatggtgatccagtctgccctgcccacaaactctccaggcatcttaacactcatgcctgtgcggctggagtccctgcctggggtcctcccttcttgcctccatctctcagcatcctctctagcctctcccaacccaaggctgtgtcccagcaggctgtgcactttccatgcagtgtgacaaagtggtgtctggggttgtgtacctgccttctcaccccaccccccaagtcacagcaccaccctcgggggatcgagcagagtcctttctctgtgtacctgtgtgtctccacttgggcacccacctgtggtttaaactcgctattgagggagaatgaaggggctgagagtagccaaggtcgacggactgtctgcctgcctccgagctgtcttatgtacagagggaagcacacatgtggtagaaattggagcatctgtaggcctgggtgggaaggggtgaaagacaggggacccataggctccatcatggttggaagtgagaggggagaggctgtcatggaacctctgagcagggcagtgtggaagtggtgtggtgtgtgcgtgcatctgagcgtgagcgctggtgaacactgtgcctctgcctgcctgctccctccctcagagacccctcctgcaggcccatcctggtgacatcctctcagctgtgagctgatggtcccagtggaacaggactgagtcccagccgctgtcacttcctcaccttcccctactccaagtcccctccctgcctctctgaagccccacccagaggctgggtgggagggagatgtacaggtgagtgtgggcataggcaggcctcctgcttggcataggaggcacactctgcaggctgagaaagccacacctctcctaaggcgcctatgccctcggaccctgggtctcacagtcagaaagctcttctcctggaattatgccaggattccctccatgggccctgccgcagccttcccatccctgccaagacactcacacgcacatctacagtgttaggccaatgtggcgttctgacaaggacggtatcgagtgagcttgtgggactcatgggttccttctaagtggaaataagagcattctgattcacggccaagagcgcagtggccctgaggcccaagcaggcaggccaggcaccccaggaggcacccgcaagctgtcggtacttcctgctaggaccccaggtgatccccggagagagacctggtggctggaatctgggtcctgagagcttcccgctcggctcaagacggaaaatactggggagagagcttcaggccccgggtgtcttgactctgaggaccgggaaataaagtgccctccgctctcccgtcacgtgcgcgtctggcgggcctgcgagcggactgtttcggtgctggtcgcccctcgtgggggatggacaggctctggggcaggcagattcagaagttctgtccctttctagctgtgggagcctcgggctctccatggaggttgtgactgaatgtgggcaggtgtccggcagagggtgagcatggctcagtggtggctgccggagctgtggctgtcatctcttttagtctctttgttgcacggtggcccagagcggctgctctttggaagcagaagctggtgctgaggctggatctgggccagagaccctctgtgcccctgtggcttccctcccggcccggagcaccagggcctgttgcctctgagggagaggagggggtgcaccccccgcacccgtctgaggtcagggcaggtgcagagctccaggcggattccccacccctggctgtctctgctccgcgtccccctctccccccgcccctaagagctggatgtggccaggaagcgcgtgcatcttctgaggtgggaacctgcctcctctcctcctgttttgttcctttaccatgacgcctgttgctcataggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaaggtaagagacggtcagcggagcgctggccctgcccgctgcagggagctcccctctgggagctccagcacagagcccgaggcctggacctctctgcctggggcctgagcagccctgatttccgggctccccagttacagagcagcccactgcagacggggcagtggcaccgtcggctgcccagcctgtcctcttagatctcacactggccccgtccaccctccacctatgcgattcccaccacggccaggcagtggcactccagcgcacagctcctggttttgtatttgatctcatcaccctgcttccttttgcatgtctccttagccctttatccaccgacctgatgagttccagcatccacactggtcactgccactcttgagtttggaaatccattccaccctgagccacttaacacacttgcatggtcacttctcatgccagactttgcctccacctcgcctcaccactcagactgtgttcccgctccacccagcttctccacagccctcagcactgggcccggctctcccctcaccttgactggcagccctgtcattctgccctggccacgcagcacctcagggtcagctcaggctctggcagtcacctgtgagaagaaggcagactggccagtgagggtatgaatccagagggctgtgttggatgatgagggcagccatggctgctgcagccacccaggacccaggcgtgaaccagtgaggctgagtctgcgaggcttggacagagtgtttctctatcctcccacgggctgctcctacagggcaggaaaggcatcgtgacccacttcttctttcctggtagccgagtagaccaaggtgcctcagagggaggcctgggctctcagtaaccctggtggcttcagcctcttgtgtttggcagattcctggctcaggatttgggcacgagggtcctgccttccccttcgggcaagttgggggcctccacaacagccccctccagggccacgtggcttttcagtggatgcaacttgagagcaggttcggctttggtgcccattagccttccttttgtgggtatagctgctcccagagagagaggctgggtggctttgaggaggcccctccggactttgagtcttccttcttcctcctcctgatcccttccattctgtcagtgctaggttgggggtcagtttatctcacccccttgctcacggccccctctctgactgggtgctcatctctgatctgctgaccccattagcctgtcctcctctgtcctcggcgccatcattcccaaatggaactcgaacttttccgccaaggttttggttcgaatacaggcgaccatcctccttccttgccctgaccctcttctttcttggtgtctcatcaacaacagtccagagggcccagagaggaccgactggcctgcagcccagccatgtgcaggacagctcgcctagcaggcctaggtcctagtcgtgggctccgtgccccacacacccccttcagccccacttcctctggccttagggggccagttgggactttctggaggagagaggtggagattcaacaattggatagccattgaccaacaattcagataatggtctttgactctgaatgccaaaagctgtttgtccaagccccaccatgaagggaaagaaaatgagtccccccgcccctgcccaagccagaaatgactgttaaagctggagctgtaactatcagctaggacccctgcctctggggcataacccccaccaccttcctctcttccccttgtctggacggactggcaaaatcaggtggcctccagagtggatcactgctggcccaactcccaggctgtccagcggaccacaccattctgttctcagcgtgacgagcccagtcctgagagtgccccctccaccgcacccccacccccacccagcccagggccacacagagctgcctaccatctcggggagccatcatcctctatgtgagactggaaagatccattgagccaagtccccagccagagcagtctcccagagcaatctctattcaattctctctggctttattgagagcaaaggcctggtctttttctgccaagtctgaaagaggtctgggtccctggcaagaacaccccttttccaggagattcctgcattggaagccacatagctgagctatctgcagtcccttcctgggtccccctgagccctggagggtccagagcacacaacctgcatggaatgtcagtgggccctctgagtgcccagggggcggagcctgggatgaaacctgggggtggagccctgaaggccccgcccaggaggatttcctctcaccctgtgatggggcatgtgctgagctctctgccaaggctcctagacccttctgaaagacaaaaaccttccagagccagagcagtgagtgcatctgagatagtggaatctcaaactctgggaggtagaaaggggctagtatgggcggtgacagatggaagcagagccagctcactttggctctctctgcatgaggcaggagagtgagggaagccatgagacactgaagctcccttgactcctcagacccttcagccatcagcccagataccaaaggagctaccctcctctcagggctcctgcctccgtccagctgcctccgtctcctccctccccttgtccttgggctcagactcgccaggctgcatgagaaatgaagctgggcccggtggtcttcagggccctccgtcgccactacctggctgcaccggctagagagccttcctgtccgtctctgtccgcctgtctgtgtctccgtctctgtgtcagacgttgtgacagcagctccggtcctgggtgctagcaccggcttgtctcagtgagtgaggccggggaaggcccactgggatgtccctatggaggtctggggtcctgtgtcctcttctgagaaggttccccgaggccagcagaagggctgtggtgggtacaggcccttgcgccgatcgcctgcggacagagctggcagtttggagcagccctcaggggctgagggagggtggttggtcaaagcccaaagccgaatggggtagacacggttttcagcttatgctcttggtagaggatccacctgtgttccagatgcccatcatttccatccgcttgcctttcctccttcattccaggatggtcagatttggggtgagggggctgggatgatgtgaaaagctgtgaactctgcttggaaagctgaggctctgacccttgacaaggaaatggtgtccaggccaaaaaaagacacctgcagccatttggttcacctccttcaattcacagaggagcaggcaggcatacagaggggacactcagggagggtgctgggtaacactcagggctgcacatccgcccctatgtccccatggcctatcccagcagccactcagactcccagctcctccctgcagcctccggggcaggggcagaggagaagctggtgtccaggggctgcctggtgccctctcctgggattgctgagcccagacagactggtggaggcatttacatctcagccatcatctcagcatctctctctcctccacaaccagtgcgtggctgtggcagagtctcccgggtgctccatgaacactgactgttggggcaggggggacacacagaatgggaaggagggaggttccacgcagtggcatctgctctctgccaggcacgctctgctgccactctacatgcgtttgttcgtccgcttctcccagcatccccatgaggtaggtacaactttacagttgcagaaactggggctcaaaaggttaagacacttgcccaagaacacatagctagcaagcgacagagcccagactcagacccaaggccaccaagctcctacatgtcttggtctgtcccaccagtatggagcacgcaaggcacctgcagtcctgagacctggctccagacggggctctgcgctagctggcaacgtggctttggctgtttggttctccgtgatggtgaacaggagctgtcccagagcatcccgtcacctcagacagtggattatctcgtccagtggcatcattagcaccaaggccaggagtcagaacagaagcaggaagaccctgggcctggtagggggtgggtcacatggtctgggaggttcctcccgacactttacttctgtgatgagaagaacatttcccactcacggttattacgcgcccttagtgtgctcagcacctaacttggttgagtaagagacccaacccttccggacagaacagggccaacaataatgtcatagccaaaatgagcagtgtgcatagtcccctggggtctggggtattcaggggatggcaggctggtctcagaacctcaggggacgtttggtctctctggcctatgtaacactgcagctgccttgaccgccccctgacatcctgctcaggctttgcctactcacaacagtggggccagaggcccatgatgttggacagggacgttgggggtcccccagccctgggatgactctggaagttatggctgtgctccccatttggccaggagtagaagatccagttttctgtccagttaaaggaagaaaatctgagggagagatggagtcacagaccaggatgagcaggagggaaggggcaggaaacagctcctctccatcactgctgcccttgacctgcacacctcaggcagcctcagcttaaggctcctgttacctctgagcaaaaccttaaggttccttaaaattctcagaataattaagaaaaaccctttggttcatgcatgggtgctctctccctagtcacccacccatcctcccgttgatccatgtctcccatcctcgcatcctaagagcttgtcttcctctcgtcttcccatcttcccctctcgtctgcctctccgcctctctcctttgtcctcccaccatccacccttccatcctgcccgtcctttcatccccctctatgtctgccttccctattgggtgtgctgcctccatccccccatccaaccagccctctcccccttgcccagatctccttctctccctttctccatcttctcatctgtttagggatctactccccatctacccttctatttatttttatcctccatctgtctgtgcatctgcttatctgctcatcgagtatcccacccgtctgtctggattctccctcttcatcctgtttgtcactccatatttcctcttacccacttattcatccatccatctatctgtccaccaatcgttctatgcatctgttcctggaatcccttcttctcttttccatccatctgttcaaacctggtaataagatgagtgagacagagttcctgactcaagggccttgtgatgtattatatgaaggaccatggaaatatagccatccctagagcaacagtgagcacatcacagttggaggcgattggtgagcccaaaggaacatcgtgaggcatctggccagcatcctgaggcgagctggggctctcctgctggtccttcgcagagcgctcctgcccatagggctttgtgacctgtgaagcgctgtgcacacgtcaggaagaatcggtgtcacagagtttcccctgattccacagagcttctggctctgctcttcagcccactacggacagagtcagccaccccccgagggctttgtagtcacggggaggacggagcctttgctcagccttccctgtgcccaccacccttggccatgtctgcatggcagtgactttggaggcccaggaaggggacatgactctctaaggaagtcaggacttggaccccagccttgtggcccctaggtccctgtctagcagacttcgctatgccgtctgccctttctccatgtctattaatagcagtaactttgtcctggttcctcctcccaaaccctaagatccctccctgtgggctggcctagcagtatcctcagccagaaggacatcctcagcacccactcccatgctagttcatgggctgggtccctgctctcatcccagcatttgaaatggtcagtaatcctgtcaccagctcctgggcccagggttaaatcagaaaaacttttgcatatgacttgtcttttaatctccttttgtttttttaaccagcatctcacttcctcattataccctctgtccgctcacagcccctcacccaccctacccggctcctctgtacatcgtgcacggcggccgtggctgcacccctgacctgagcacgcgggcagagtgatgtcnnnnnnnnnnnnnnnnnnnnnnnnnnnnnnnnnnnnnnnnnnnnnnnnnntccctcctccccctcccccctgcccaccttcccctccctcccctggcccccttgcccgccctccccctcctttctgtcctccttgcctctgctccccctccccttctccttcctcaccctcttcctcaccctcttctccagtcttcccaaatacaaagagacaaaggctaagttcacggaacgatggcacccacgcccctccttcttacagcacgcgcctggagccagagcacttgagcattgctgactgtcacgcaggtagagcacccggcacccggtgggtgctcagtgaatgtatggtggttacattaatacacgagtattatagtcaacatcgattgagcatccacctgtcaggcatactctagacacgtgccgtggttatcttggcaaaccctcacaatgacgcagtgaggtacatacttttatatgctccacacccacactcacacctccacactctggacatgggcttggtgctcaggtcttttagagctaggggctttcaagagacccaaagccaggcagacctgacagccccctatcacctctcaatcccaccccacgtcccagcaccacaccccagcctcagtcccccagtagcaagagtagagccatattagggccagtttctgtgaacacaaggcagagtggaaggtgagtccaagtcagcatgtctggccgggccctgtcgggcctcagcatccaagaaggaggccagagcagctcttgggggtagataagcaaccagagatattcttctgcagtgagcaaacctttggccagatcccctaaaatcagggtcaagagagtgtgaaaaagcgaggtgtgtgttcctgtgtcttgtttctttctgtttatctgatttgggaatgtatgtgcagtcttaaaaacaagttagatcatatttccttttaggtgaaatgaatcagctttattgaacagaatacactgaactcagagctgtggcctccaaaatgagaatgtggggttactgagttgatcaagaaagcacgtcaagccatttacagatgtcttattaagtcctcataactgtggtagaaactggtgtcactcctttttaaactgaagacatttattaaagctcaaacaggttatggaagttgtctgaggtcaggcaaaaaccactccatgtggctccatgccactccagtgcctggggggctggacaggggagctgcacccaagcccagagccctgcctgggtgggaggcagggtgtgttcactagcaccgcaccaggggtccactgggcaagttcagcttcattttcccagtgaggccgaaaatgatgaccagatgaccttgtttgagaatgcctgaaatcagtgcagtcgttctagaaataattcctgccagcaccagccctattctaagtcctactctaggtactagaggttcttcaatgcatgaaatatagttcctgtcctcaggaagcctgcattctagaggggagccgggtagtgaacaaatgtggaatagggcaagggccttgagtatgaaataaagcatccatgacaggtagggaagtgtggggagtggcctctctgtttaggtgatgtgagccgcgaacatgaggcagggggtcaggaagccacgtggagcctggggaagggctctctctgcaggtggaacagcgggtgcagagcccctgaggacaagagttgggaagtcagagacagctgcggctgtgaaggtcaagggatgggtttagccgcctgctggagcgactgccctgactctgtacgcagaggatggccggtagggggcgcggctggaggcagtgatgcaggctgagcacgtgttggactggggggggcggagggaggtgaagaaacgtgctgttaggttttgctgacacatcagggcgggggcaggtggagggtgaacgcatgagaataaaagatccaaggatggtttccgaggtttatggcctaggaaactggaaggatggagttgccatttcccgtgatgatgaagattcagggaggagcttgtctgttagacgcgaagtggttgggaggtggccaggccggcgccgcagccccgcccctgagggtgaggaggttgagcaccagcgccaccgtgtggccagacctccccagcgccccggcgcgcttcgttccacccgtcccttggctccagagaggcgggactttgtggagattgacagtgaggggtattaggaattattgatcggcaggggcctcccgtagagctctgcaagagcccagatgtggggggcctggcgaaccttgtgctgggcacgggaatcttggattccgtcactcctgagttgggtgcctagggcagggcaccagccctctgtccctcagcgtcttcatctgttacagactttaggatctttcctgccgaatatcaggagccgctgatcctgactccctgactggtagcactacccctctgaccttcaactgcagcatgagatgctggccgtgctgcctgtgtgttgaggttgtggggtacttggggtgagaagagctgaggtttattgggtacttactaggtgtcagaccctcacaatcctctcagcagcttcatgaggtggcttttattattcttacccccacccccaccattttacagacaaggaaactgaacccagagagaaaaagtaaattattcgacattgcacagtaaggaaggggtgggactgagattcaaacccagaccatttcctgcttctcagtgcataaaaacatttttaaactggcagtgtaatgatgtaggggttataaaccttagtcctgactcagccattactttctgggtgaccttggggaaacatttgcctgctctgggcatgggtttccccacaggttgatgagaggtgaggctaggtgaactcctggagctaaagtcttagggcaaagctttagggtatgttttgcctccccctcacgacccctgctctgtggtccccagccccttccgcctctctggtcattctgctcccagctgccaggaggtcatgcccttggcctcccttcacctgacagctccaccccgcagttttttatctacatcctcttgcatgcccgactgtcatccatttgctgagtgctgagctgtttgaaagcacaaatgctgggctttctggtcccggtgcagcttggcatagtggggtccagagaagcatggttgtaccagtgacctgagtcagctcatgtgtccagctctcttagttagtagttgagtggatgctgacatgagcgtagtgttgggccagcaggacccaaaccctcaggatcctgccaggtgggcgagatgttagcggagctctccccagagtcctgattgctgccaacttcagagatgcccaaactaggtctgtgtcctgttagagctgaccccgctggtggggctgccccagcagaagtcagaccaggaggctggtatttcagagctctactctcctccccagctgggagcaccaggggttctacaagcaccttctctggacatgagtggctgggaagaggccctctccgcaggctgaggtcagcttagccaaaccttccaagggaacagggcctgccacctgccagatgctattgtgccaggcatcagcagcgtggccacagtggcaggtgtgtatgtgaactgaccgtgcccagtgctgctggccccgccagcatggctgctgtattccagaataatagatgtctccatgaatgcgctgagtggctacagttattaatatttgagcccttgatatgtgccaggcttgtgtttcctcctcctagcaaaccttatgagatgagactgtcatattcatttgacaaagatggagacagaggcccagcagagtgacttaacttgctcttggtgaagccaggactgaatactaaccaaaaagaaaaagaaagggaaggcctgtcttgtttgctgtggtttgatgccagccttactacttactttgcctgggcaaggtaaggtgaactgtctcatcttagttccctgtctgtaacatgaagataggaatagtgcctaccgggcaggattatttgtggattaggtgaattaacgcacatgcaggccctagagctgaaccttaacatggtagatacgaagtcatttttgctgtttacaaagtgctcccataccctcaacgatcttggccgtcaggcggggtttgtggcacagagcagcgtggggtgcggctgtaacctcgggcctcctgtgtctgtccctcaggaaccagtgatgacccattccaggactcggaagggcgagagggcgcagaggccgtggcagagcaccagttttcagacctggacgactcggactcggactcggacctggacgaagacgaggatgaggacgaggaggagagccaggacgagccatcaggcccgtcctcggaggcgcccccacctggcccgccagccacgctgcccgcagactcctcacccgttcagggccctcagcccacagaggccacccggggcagctcggtctcagaagccgagcgctcggcacccagcagctgctccacatccagccaaagcatcctgtgcctcccccggctggcaccggccccccggggcccagtggagaaggacacaggctcggccctgagctcccaggccctgtccccaaggaggccgtggtccccaagcaaagaagcaggcagccacctaccactcaccccaaaacactcactaaccaaaagctactcgtctccccagcgacattcaccggcccgagagccactggcctcagccccgagtccgcctggctcccagacgggccctctcccctgcgggtccccgagactcgagctgtcgcctcttgccctccaccccctgggaagggaactgccacttcgagcgcgcctgccccccgaacgcaagggcgctgcagacccaggcccccccagacactcgcccaccaggagatggtctccaggccaggccgagtcaccaccacggtcagcgctgccagggaagtgggccttggcagggccgggcagccccttggcggccgagcgtggcccaggctcagggctggccccccgggctctctacccgcccgcgcctctacctcacaagcttctcggcagaagcccagcggagacctgcacctccacatgggtgagttcctgtcccccaagtggctgatgggtggggggccgcgagctcacacctccctgagcgtcacacccagagctggacccctgccagttcagcggttaccaataaggcgtgcattgggcaccacttacacaggcactgtgctgggtgcctgaaaccagtcagctgtgtgtcagaagcagcggagcatggactgtggagctggactaaaagaaagtgaaagtggaagtgttagttgcacagtcatgtccaactctatggactgtagccggccagactcctctgtccatggaattcttcaggcaaaaatactgaaatgggttgccatgcccttctccagaggatcttcccatccctgggatcgaatccaggtcttcagcatcacaggcagattctttaccatctgagccaccagggactacctgatagtttttaaattctggactacccagaattaaatccgggttctgtcacttacgagccgtgtggctttagatgtggtataaacactcatgccatctcctcccaccccatttccacgtattctttgagcagatggcagagcccaacccaaatctccacatctccaacatgactgccaccagcaccctccgagtcacttgagccagctccttcccatcttcccatcagcaccgtcactgtcacatcatcagtgccatctgccatcagtacactccagccaccccataggcttgatcaccgtggtcacaacatcactgccaccaccacggtcacgatccccagcactgacacgttatcatcatcggcttacttttcctctcccaacaccttttctgtcactggagtgtcacgacccaacatctctgctcaccgccagcagtgtcagcaccatcactcaagcgattcaagctccaggagtagtaccatccaggaatcttaacttggtttttaatttggggctcaagttaaaattcctggtggtgaaaaagtgaaagtcgctcagttgtatccgactctttgtgactccatggactgtgtagaattctccaggccagaatactggagtgggtagcctttcccttcaggggatcttcccgacccagggatcgaacccaggtctcccgcattgcaggcggattcttggtggtgggaggaggttaagagcctggggtgggaactcatgttcaagggtaaagttgggtcagtattgtctgaggaacaagagaggcagcagaagcaagagagagggccagcgcacagaagccaacagaaggggcagctccattctctgaaaacgaacgcgctggccagaagcgtggggaccttggttcctgagtgtgcctatggccactatagggctggagatggcccattccagagagggcacccacccagggtgccaccgttggcaagggttgggactcaatggtggcccagctcagctaggacctgctctgtgatctcgccaagccccctcctcactctagtcctcagggtctccaggtgcccagcaggtaaccctcgccttcctctgtcttcttttctgaccctagcagaaggccgagtcgccaagtccgtcctgttcacctgctcccgctcatcctctcttctcccgacccttctcggccccccatgacttccacggccacagcccggcccggacggagaacatcttcagccacctgcctctgcactcccagcgcttgacccgcgccccgtgccccctgattcccatcggcggaatccagatggtgcaggcccggccgggggcccaccctatcctgctccccgggcccagcgcggcctgggtcagcggtttctcggggggcggaagcgacctgacagggtcccgggaggcccaggagcgaggccgctggagccccaccgagagctcgtcagcctccgtgtcccccgtggccaaggtctccaaattcacactctcctcggagctggaggccagggactaccccacggagagggggaggacgagagggggcctgggcagacctcccgactgggagccccgtgcggcccaagtgcccacagagcccacgccgacgcacagcccccgcacccccccagagacctcaccccgggcacccccaggccaccgggcagagtcccggagcccccacctggagtcaccgcgggtgccggccaaccctgcggcctccgccaccccgccgctggaccgcagcagttccgtgggctgcctggccgagaccgctgctcgcttcccagcccggaggaggaacctctctggggaacccaggaccagtcagggctccccccagccctcgggaagtggggggtccgggacacctccacaccagcccgaggagcgggggccccggagcacttagcctctccctgaccacttcagcatctggtttctggtgtttggcaacagacgtttccagccgacttcctcgagtcatcttgctgtcacgggctccctgtcccatctgttgatctttccaagcagcttctgctcagcccccatctgtcttatcttcccacctcgtatgcagttacctgtgcctttttctatgaccttttgttgcttgaaaagaaacaacacacacacagacataaaaaaaaaaaatcccacgaggagactgaggctgtgaatatttagatgggacctcaccctgggccactgcgatcagcagccccccacaaagctggcaagaggcagtcagttgctgaaagaaaggggatgcactgagggagagacagagaaaaaaaaagaaacttttaaaaatatataagtaaatgtaaaagcaagcactcctatgtacagagtttatggttcctatttattgctgcttcatcccaccccagctagtggcctcccctggctgctagcagaagggtcagcggcccaaggcagagggacaggctgggagactccatgggcaggcccagaaaactccaactttccttttccaaagataaggtaaattttcctaggatttcaacacaaactgtttggagcaggtagaaggtagttgctggttgggtccccagggctcgcagacaccctggtggtctgactcgtgaccccattctggcatttgactcatagacaaatccccccaccccggcacctctactctgcactctgccctcaacctttggactggggaaggagccctgaccacccatctcccggttcctgagcacctgacctcggccttgctctcagggccccagccattgctgcgcctttgttctagtaactacccacaaggctgaagggacaaggcctaacccctgggggtcaagatccaaggtgcattgccttgccattcccaaggccaggcttgggcttcatttcacatttggtccctggggtacaaagggctctatttcctccatgactgggcttttccggtacttagcactggaagtttccaaggactcatttctggacctctttgcagcaggaccagtcctcctattggcgtgtcacacactgtcaggcctctactatccccaggaagtacccagaaccatgactggtgggaactgcccaggcctcctattggttggcttaaatctcttttaaaaaataaaattatatatgtgtatatatacatatatatacatacatatatatatatatatatatatatatatatatatatatatatatatatatagaaagagaatggtgtttgatatttcccctagcctcctattgtccgaggtcatttcaattcttctccaaagcaatcaagaataactagtgcctcatttctcatccccatctcctcctttaagaagctgccctgtgttttctggggcaaaagcctgctttgtaaaaaataataataaatagtaataacatgactagaaattaaaatcccaagttgaaatatagaacttgaactctagcatgtttacccagccctgggatatgtggggttttccccaacctccagaaattcttttcttttgtctctaccagggggagaaagcacaaggaccgtggtcacagcccagccaggctaggtgctaatgccgcagagcagggacctccttggccggtcctcattcctcagccaggctgtatgaatcctgtggccagagggggctcctgggctgttgaagttgcttagacaggacaccataaggtgcagagggctacaccatgcagaggcacctctgtgggctcctacccttgggcgtaattccctcttccaccagttcaggacttttccttccttggactctgctgccaggacaaactagccaggccacctggttcatttccctctggctaagacaaaaaggggacaatagggatgggcttccctgggagggggtggctgggccccagggtgctgaggctagggttaaccagcacttcctggctgcctgacccagggtctgaagctcttggtccccctggaagaaggctaacaagcccagccttggctatgctggcacttgtgggtcctggcagaaagctggaaggagccccggaccccagtcacagccttggccagaggctgggtttttcctcacccttgctttccaaccttaccccagggcaaaggtgagggacatgggaaggtggctgcctaaggactggagacttcaagggccgaggcctgggagctgaataaagggcattgcttcagcccaggcttgaaatcttcctgggcaagatcttccagctcccaacctacagagcagcaaacagggggctctgctagagtagcccctgaccttgggggtagccaggcccctcctccaagccctgccccacagctctccccggggcatcattcctctggtactcagacagcccaactactaaggtttccttcctggagccctagtcatggctggtggtggtcagcaggggagagtcaggcacaggcagaggggatgggggccaggagtcaccagagacccatttctcaatgacagacacaatgtgcaagcaatctggccaaaaggttgttgccctgcacaggcatccagagaaatggacttgatgccacccgcctgggctgtatgtcactgggcatggctctcaccctctctgcctcactcaactcctgctcccccaaacacagagctcccagcccgcacgcacacctgcatgataagggaaagactctcacatcacaccctcctcctgccctgctcccagccactttcacatttccagcctgcctgtgacactgttgtccctgttaagggacacagtggagaaagcagtgcccattgttggcacagacacctgtgcctgttctgctgaaatgtgcaggacagtcattcctgggtacaggctggctctggtcctcgggtgttggcagccttgcgggctggagaccaacttgctggggtttcagagccagctcttgtcatggggattccaagccagccggcccccagttctaccctccaggatgcccttcaccctcaggacaagctcagggtcattctgggcactaacctgttcctctccaaggcaccttttacaagcctacttcccctgccccaccacccaccaaggccccgactactaagaccctccaggaagtcaacagcagcgaactgcccactctcccacctccatcacctccaacttccagacccagcagtcccttcacctctctctgtgttaacaagtctgaaagatttaatttctgggtccaggtagcccctgctccatcctcacccaacccttttgaataagaataatcaagataactaagctgaattgctttctagtcctttctccagacaaaacctcttcaaaataaaagtcctgcctggacagtcgtccttggagacagatctgcagcactgaccaaggggagaaagttcccaaagacctgttccaccaattctgctcctgagtcgtgaatcctgtctgctttccatcagaaaactgcttcggcacttatgatcactttactaagcctagtgttaaaaaaggaagagaaaagaaacagaaaaaagaaatgtataggcaaatgtaagataacacgctctctgtaagatagaaatttgccttttttttttttttccctaaaaggtgtatgtattctgtatgtgaaattgtctgtagagagtttctatgttcttaaatggcaatacattccaaaaatcgtactgtagatatgtacagcaaccacactgggatggggtagttttgcctgtaactttatttaaactccagtttctctacttgcatcttgcaatgtcggtatggtatatatatcagtgcaaaaggaaaaaacaaaaactcccacaggtctaaagcacagagtctgatgtacaaaaagaaaatactgctcagtattgatgtgtgacctttgttgtaaattacatctgtactgtgaatgagaagtttttacaagtataataattgcctttattatagctctggctgagtgttcagcctgaggatattttttaaaaaaaaaacagcacgttggaataaatttgaaaatcccaacagaggcctgcttgcccggctcatgatttttcttagggctgtagaatgtcagagctggaaggacactccgagtcccaagtgctttttctgctacagagaaatcagggccagggaaggcgagtggccaggccatagtcacatagcctgggattccaagggcccggcccttccaggcttggcaggaggcacgggtacatggccatgtggtttggggtctgtattcatttcctagggctgctggatcaaatgaacaaactaaatggcttaaaacagcagaaatgtgttctctcacatttctggaggccagaggtctgaaaccaaggttcctggggaggctctgagggaggatctgggccagacctctgtcctcacttctgggggctgcaggccatccttggcctttggtttgtcatcacagcactctcgtctctgcctctgccttcgttctcgctgccttctctgtgtgctgtctaagggtcctcatcactggacttggggaacacgctcattcaatatgatctcatctctagatctttaactgaagtatatctgcgaacactccttttctgaaggaggtcacacttacatgttccagggtttaggacatggacttacctttgaggggccaccactgagcccctcaaggtaagacctggaatctgatcgtgacagttattcactgcctgtgtgacactgcgcaagttacacaacctctctgggcttctgtttcctgttctgtgaagtggagggtttcctgtgaggattaaatgagagagtatatgtgctaagtgctaaatcacttcagtcgtttccgacttggcgacactgtggactgtatagctcaccaggctccaccatccatggggatcccccaggcaagaatactggagtgggttgctatgccgtcctccaggggatctttctgacccagggatcaaacctgcggctcttatgtctctggcattggcaggcaggttctttaccactagcaccacctgggaagcatgcatacagcatggttaacagaaccttgaatatggtacggcgtcaacaagtgtcctctgagcagacctcacacagggtgctgtggttacaaggatgaaaaagtcaggtataggtccccaccttttgtatgcaacaatgacttgctctgcaccaggcagggactaatcatcagatacaacagtgagcaaatcagacagccctgccttcagagaactttcattctaatgggagaggccgtccttaagcaaataacgacatcatcaattcctcagtcccagtggccgtagttgttgctacaggagagaacaaagctctcacacagagtaagtcctaaaactcctgtgggctctggagcctgggtgggttgtggggagggctgcaggtggaggtggagtggaggggaagccatgataggagcagacagaagaagaggtacgtggacaaatcaagagaggccttcggggtaaaatgctggacacaagtttagcactaagaacctaagagggcctgcttgtttcagcggcaggaggatcattgctgacttggggaaaagccggcctgttccagcgcccagtctgcaggcccttcgtaaacactgccagtgctgaatggattgtggaggcagggggtggaggctggagagtgaggagaagagggaagtggggacggcagacccagacatcctccccaggacctgaggggagggcaggggagagctgggcagcagctggagggcagcaaggcgtccagggaagaacggagatgggaatgaggtggtgagaccccagcctgcttcattaggaggagatgtaagtaccagatgcagaaatttcccccagtgtgacccaagggaagaggtgcaagtgataacagtgaccggaagttgagaacatttccgccacggaattttctctgtcacctgctgagaagggaagaggaagctccagtatggggtagggggtgcggagcgggggtggtgtggactaaagacttgagaaagaaaaggttggaaattgtctttgttcattattccagaggcaggacagttgtggatgaaggcagtgtggaccacacaggcgtgggtgctgggcacaagagatgaaaaggctgggaagcgagtatccatggtgccagtgacctgaatgttcatctctgctgaccacagggctggactggaaacccaggctgtgagctaggcttcataatccaggatatgggctgtcacgctgcagaaacaagcaagccagaaactccagaactgaaaacaatgaaagttgaactttcccctctgccatctgtcccatgtgggtcagcagctgaagtgtactcatcctcatcatttggagacctaggctgctggacgctttatcccgtgttcctgtgacctcagaggcagaagaaaggagagagctgtgaaatgttgcattgacagctaaatgctctacatgggaaaagacatctctcctttcaaatttcacctgccaaagcagatcatattgctgtgcctagtgacagagatgaggaatatgtgtgacagtcacacaaggatacgacttcccagtgtcagaaacacccaagggctgagcagatgtcaatgatgggatgggggcagggacagggcctcatggcatcggcctcaaaggtgctgggtttttacagggagtgaaaaaaataatggtgtgcaaggaggcctggaagaaaatggcccctggcattttgatcatggggtgtggaaggcaaggagcagctgtctgggagcgagtccttggggagatcctgaatttcagtcgagaccagtgggaaagtggaatcccaaaaaggcccaggagaagaagagcacagaatggagccaagtccggcctccagcattttacaagccctatttatagtccttgggcttccttggtggctcagtgaaggaagccacctgccaaggcaggagagataggttcaattcctgggtcgggaagaacacttggaataggaaatggcaacccactccagtattcttgcctaggaaatcccatggccagaggagcctggagggctacagtccatggggtctcgaaagagtcagacatgactgactaaaaacaacaatgtatagttcccaacgacaacccagggagatgagacttacggtccccatttttagagaagaaagtggaagttccaaagagcccccaccaaggacttcctgctaagactctgtgctcccaatgcaaggggtttcagatttgacccctgttcagggaactagatctcacacgccccagctgagagtctccacgccacaacgaaagattccacatgtcataactaaagatccgacaagctgcaaagaagatccaggatcctgagcagatcctggaaagatccactttccaagttacaacaaagactcggtgcagccaaatgaatacaaataaagaaagaaagaaatattaaaaacaaaaggacccccaccagccaaagatgcagggctggttagaggctgtgtgagactgactctagcctgactctggtgcagcgcctctgggagccccaagttcctccctctcatctcctccctgtgctctggccccaggggagccctggatctcagactcttcacctccttctccccaggaacccaggggaagaggcaggcccaggccaaggcttcttcccagcagctgcctggcttctcgcagccatccaggatagccccgtgtgtccccgtgtctgaggctgaaggcgcagggatggaccatcagactcaggggctgggattccagtgctcgagagcatgccaagtgcatgcaaactctctgaagaacctgactccccagcctgctgctggcacccaggcccacctgtcactcacaccaagcctcccatggcctctcgtattcacgaggcaatttcccttttggagtgagggagatagggcacctacttccacttcacagaagaatagatcccaagattgcaccctggcaagtggcagggccaccgacccgggtcacacctgacccagaacctcaggaaggcttgggctgagccttgccactgcccatcagggctgggccttctccctaggcctagaccctctctgggcttaagacctagagaccatgcttactcctagagattcccagggacaaaccacggctggcaggatggcctcagaaggcaggccagcctgagatgggcatgagcagggagaaacaggaagcaaaaagagtcaaataaggatgggggcgactgaggagggagcagcccagggctgccctgcgtgggactcatcactgccatctggcccggggagagacttatcacctcgtcactttgtagaggaggaaggctggggcttggacaggtgatgctgctcataaggccacagtggtcaggggcagagcagagacttaaaaccaggcccacacattcagggagtggttgggactatggaaagggaatctgggcctcttggctacctcttagtcctgaaatctgggttgggggaccccagcagacatatcctttaattccatccagcctcagccactttacagagacccagctaccaacctcccccttttataaatgagaaagttgatgtccagagccgggaagagcttggcccaaggccagagctaggattcccgaaccctcagcagagccacctggaccactccgcccacccctccttaccccaggcccaggttcacctgcccagatctgcctttttaggaaaggaaaggagcagccctggtgggggcaggcgggtgggcaggcagccacgctaatccactagctcccggaggctctggttaccgtggtttggggcccgggcaaccctggctgggagtgccagcccagccaatcggtgctgccgctgagctactctgccagagccatacaaggctttgctgcagccctatcttgagccaccacaggacagccccagcgtcggcagccgccccgcccgggagcctgccagcccggcacgtcctcggactctgcctaatccaacctggaagcaggcagggctgcagcgcacgtgcaccgggcccagggttccccaaggccaggaaggtggcactgccagggcagaggccagaatcggggcaaagacctagccgggcatcggagatcctggctggggtcagggatgagctcaggtctggtccaggctgagctgtatctctctgtaagatgctcttctgttcccatcacccctttggcctgactgactgcttatccttccccattcaccgtggagacggggctcagcacagtgagtatctggtcccttctgaggtcttctcagggtccaagtcccaactactctaacccatccagggtctgaggctgcatgcacctctcagaattggggcgtccatttctaagtgcacgttgtgagcatcaggcacatacagccccccctgtggtctttgggggtccactgtcactgccatggatctgggccttggctgtggaagcaggtggggaccggtgacccctgcccagtggagcccatcccatctgtcagtgcataacacctgagtgttatgaattcacaggacccccgaggagtggaaactattggccctgtttggcaagcaaggaaatcaagtcacagagaagttatttgtctgaaactggagtgtcaggattcagccccagagtggtctgactctagatctctagaaatttccgatcctggagggaccaggggctgccatttacactgaagtgtgaatggaggcgagaaagtcattgtctgagataagaggaccctttctttaaaatatgtatctttttattctttcgttgtttttggctgtgttgggtctccgttgctgtgcacaggattcctctggttgtgacgactggggctactcttggttgtggtgcatgggcttctaacagcggcggcttctcttgcggagcacaggctctagagcgcacgagtctcagtagctgtggtgcacgggcccagttgccctgcagcatatagaatcttcctggaccagggattgaacccgtgccccctgcactggcaggcagattgccaaccgctggactatcagggaagtccaagggtgccctttgttcctgaattgggtagggccaggcccccagtgcacggccattgcccaggccctggtcaggttgcccacgcatgcagcggcccctgcagagcgtcccaggccaccactgtcaattagatttgtcacggaagttcactgggttccaacatccttgtgtgtcctacgtgggccaagttgagctcaaagccaagactgcggtactccccagggccacccggcaggtgagagaaacgtgccgacctggggggtggcaggccaggctggcattaggctctgtttgctcacccaagaaaggaagagataaatatagacacaggattactcagacacagcctgggaaaaccggctccgaacctcgacttcagccctggcccggtctcaccttcacccgcctgccccctcggtgtctgctgccaggcctgccccacctgttcccaggacgccccacctgcaaacttcaggacagccgttcctgcctgccttctgggggcaggacagaaactgaggcccagagagagcagggcacccgcctcacatcccacagcaggttaggagctggtgacgcgagggctgcactgcgggagtcagtttatcaggtccaggcaatgcaccagcccagattcggtttccatatttgtgagatggggacctggtacccccggccctcaacgccctggagcctgcgtgtagggtagagttggagaccacgcagcagaaaggggatgaagctggaggctcaagcacaggaaatgctggcccaagccgcatgtgtagggcttcagcactgggactctggagccaaatggcctgggcttaatatccccctccaccattttcagccaagagatttggggcaagtttcttaacatggtgccacaatttcctcatctctaatataagaataataagaattgttattctatacaataaataatatgtacagtattatttgggcttccctgggcggctcaatggtaaagaatccacctgccaatacaggagacatgggttcgattcccgagtcaggaagattacctggagaaggaaatggcaacccacgccagtattcatgtgcttagtcactcagttgtgtctgactctttgcaacccttttgactgtagtccaccaggctcctctgtccatggaaatcgggggcaagcatactggagtgggttgccatttcctcctccaggggatcttcctgacccagggattgtatcacatctcttgtgtttcctgcattggcaggtgggttctttagcactactgagcaaccagggaagcccaaataatactgtctataatactaaaatcccatggacagaggagcctagtggactatagtcgatggagtcgcaaagaattgaacacaagtatgatgttatatatatgtacatgtatatgtgtacgtatatacacgtacatatatgcacatacacataggtattgatacatatatacatgtagacatgtgtgtctacccacatttgggtctcgcaggaggtgctagtggtaaagaatcctcctgtcaatgcaggagacataagagatgcgggttcaggtccctgggtggggaagatcctctggaggaggggatgccaacccactccagtattcttgctggagaatcccatggacaaaggagcctggtgggctatagtccatagggtcataaggagtcaggcatgactgaagtgacttaccatgcatataggcaccggtattcttgggtgggaaatcccatggacagtggagcctggcgagctacagtctatagggtcacaaagagttggaaatgacttagtgactgagcacgcaggcacatatatgtagatgtattatttacatatcattacaataataatagcctaataacaataccaacctctcagagtgttggggtggattaggtgagattagtacaaagcacttacccagggcctgacacagagcaatgactccacatgcatgtttatgatgatgcagccactggggcaggtgggggcctgggcgcaagaggcgtgggtgggcgtctccaagtctcctgccctccaagggaagagctcagccctgagctctatggtgcgttggtctctcctgcactgtgacccttgcagcagctccctgctctgcctgaaagcttcaagagtcaggcagacatggatttgaaggttggctcccacttacgggcttcccttgtggctcagctagtaaagaatttgcctgcaacgtgggagacatgggttcgatccctgggttgggaagaccccctggagaaggaaaaggctacccactccaggattctggcctggggaatttcatagactgtaagagtcggacaaaactgagtgactttcactttgccaccacttacagactgtgtgaccttgggcaagtaactggccctctccaagcctcaaaatccacttttatccctcttgggattggtgtgagggttaaatgggggaacaagtgcgaaactctcagttcagccaggcaagtggactctctatgcttgagctcatcctgagccccatctcttgtttcctccagtttctctcagtggctatgagctgagcccaggacaggtgcatgaccctctgggtgcatgaccctcacacatgcaagggttctcagttatgggaaacactcaccagcccctacatcatgcatgagctcatgttcctgcccttgggtccctggagccatcagagatccgcaagttccccctgtactcttcatgcactcgtgcatatccacacaggctccctctccacattcctgcacacgcacatgcgtgcatctatggacacacagggcacagctgtgtgcgagctcggagaggctggtgcccacaggtgtgtccctgcacacctcaccagcacgcacgctgccacagtcaggggtgttctagccaggcctgccctagccaggcctgcccctgaggtggccgtcttcacagcagaggaatgcagacagctggggatgctctgccagcggacgtgagggagaggcccaggggaaaccacacgggcaggaatccaggcaggcgttccaggccaaggtggagtcctaaggtgtcaggaagtgcggggggggggggcatgtgcagactctaacttgctccagtctcctctctcatcaccctgtgtcctcagcctctaggacttggaggccaaagggttgcacagaccaccgttctccatccaagacagccagccagctctacctgcacagccttgctgcctagcagagcactgggtctctgggctgcagtggcctggtctcagctagaagggatcattcttggcatagggtctttcttcctcactggggaagaatctatgatcacagaagaatctatggggagaatctatggggagaatctatgacccagaagaatctatgactgcagagatcagcagaagaggagtgggttttttttttcctcatttttattaacatatagttggtttacaatgttgtattagttttcctgtatagcaaagtgaatcagcaatatgtatacatatatcccccctttttcggatttccttcccatttaggtcaccacagcacactgagtagagctccctactccctactactaataagtagattctcattcagttcagttcagttcagtcactcagtcatgtctgactctttgcgaccccatggactgcagcatgctaggcctccctgtccatcaccaactcctggagttcactcaaactcatgttcattgagtcagtgataccatccaaccatctaatcctctgtcatccccttctcctcctgccttcaatctttcccaacatcagggtcttttccaacgagtcatttcttcgcatcaggtggccaaagtattggagtctcagcttcaacatcagtccctccaatgaacactcaggactgatctcctttaggatggactggattggatctccttgtagtccaagggactctcaagagtcttctccaacaccacagttcaaaagcatcaattctttggcgctcagccttcttcacagtccaactctcacatccatacctgactactggaaaaaccatagcgttgactagacagacctttgttagcaaagcaatggctctgcttttcaatatgctatctaggttggtcataactttccttccaagaagtaagcatcttttaatttcatggctgccagtcaccatctgcagtgattttggagcccagaagaataaagtctgacagtgtttccactgtttccccatctatttgccatgaactgatgggactggatgccatgatcttagttttctgaatgttgagctttaagccaactttttccactttcctctttcactttcatcgagaggctctttagttcttcttcactttctgccataagggtggcgtcatctgcatatctgatttctcccagcaatcttgattccagcttgtgcttcttccagcccagtgtttctcatgatgtactctgcattagttatctattttatacatagtatcaatagtgtatatacatcaatcccaatctcccaattcatcccccactctttccccttttggtgtccatacatttgttctctacatctgtgtctctatttccgttttatagatgagatcacctacaccattattttcagattccacacatatatgttaatatgcaatatttgtttttctgacttcactctgtatgacagcctctaggcccatactgtcatcattggctcaagtcagagatgacggagacaatgtggaagtcactagaactcttcaggcaggactcatactgactcagcagccagtgtatgttaggtaaggcacttgcatctagcaactccctgagtgcttacaaaagggcctctgctcccatgtacagatggggaatctgaggggcagaggcggcgtcacctacccagatcccctagctggctgactccagacaccagtacgtaaccactgggccatgcggcctctgtcaaagggcacatctcacaccctggaggagaggtttgcaaatgaggctgaaacactgctggcacatgaaagccactgtcccacatgcaggggcagcccagcccaggtggcagagagggctctcccaggtcacagctacatagagatggcagggggaggctgagagccatccaggcttttggcgtcttctggcagcacacatccctggggaccagctgaagctggggaacatgtcagtgttccaagaaatggcaggcacgaaggtgggacatggcctctgcaagttcagccctggggtggagagaggtcattctccatcttcatacagaaaacatggcctaagagggacagagaccaaaaagttccagaagagactgagcagggagaggggctgccagcggagacctgcctccacttcctgaatctctgaggccagggtgacaagtggtggcctcctgtgaaaggcccccgagccaactaggtccctcaccctccagctctagctatttgctgggtggaactgctggggaggagcatgctaggccctggtgctcaggacctcatggatgagggaaggaagaagggagtcagtgcttgaaaaaagtccatctggggaccttccctatactccactggccacactgcctgccccctgcaggttctgtttacagacctggccatttatttacttgctggggagcaaaaatgggaaaatgacagtgctgtcatgggaggacccggaggcaaatgacatgcccaaggccacacagggcagaggattctgacttgtcacaactgctgcttccaggaacacccagatgcgtagccccaaggcgtcacgctacactcaccggggctgccctggggagccgagcctgccctccaactctctggaagaacagggacccaggcacactgcccccggggcagatgactgcacttctctgcgcctctggttcttcaaacagcaatgccttccactcaaggctgttctcatcatccgacggcatcgaacttagatcaaagcatgacctggcacaaaaagcctctcaggcgcctcccctccgcccgaagtttccaaagacttctctaggcctctgcactccttcccaaggcacagctggacttgagacctcgttgtccagcacgagactcaggggaggaaaacaaaccaagaagccagcgtcaccccacttgtcagctggacagacccgcggtccagagaggggcagtgacttgggggaggcacacaagcaggcaggacttctcccataccagcttcatggagagaacaggccttggaccccacgtagtgtccccaggggaccctgggggtctcgctgtggctaagcggcctctcatcccacccaccggccctgcccccaggggttgccgtcctgtgacccacacagggcgctcgggctgccagggccttttagagtcagagccgctgagacttgggaagggggctggcctccctgaggtctcctggggtccccagcagggcagctaagacctgagtccccagcggcacgtggcggcgctgcccgatcggtgatgtcaggcccaccacacccgggccccagcacgttccttctcagagtcggcagagcagagaacaaagcgtcctgcgcattcttgcacgctgactcatcgcctgcacgtagagccacagcagctgctttgcccaaaattggtcgggaggcgggggcgcgccagacatggcagcctggggtcctctgctcactcacctgctccacactctccaggagcccccagtcccaggatttcccaaaacaggcaggaaagcaagaggcactggggggcatgctgttccccaggatagccagggctaccccctgggggagggctcgtgatcaggcacaggtggcaggctggggataaggcgtagatgcaggcactgcttgtctttgagcctcagtttcctcatctgcaaaatggggatgtgccagttaccattttaagcgtttgatatgagttcttttcccatattcttacaccaaccccaaatggaaatactgttatcatcatcatctcacaggtagggaaactaaggcacagacactgatttgcttgaggtcaggtgctagtgggcttccctggtggctcagtggtaaagaatctgcccacagtgtaggagaggcaggagacatgagttcagtttctgagtggggaggatcctctggaggagagcatggcaacccactccagtattcttgcctggagaatccatggacagagcgtctggtgggctacagtccatgggattgcaaagaattggacacgactgagcactcacccaggcacaagtgctagctagctgcagaggtaggatttaaatatgaattgtaaggttccagaatctgcatgtatcccctatatgctaaaatgcggattgaaatatctggtgcccagcaggtgttctcactgtgccctgacccttggtggttgagcctggtccctcacttcacctcactaaacctctaatccctcacctgtaaggtggggtaactgtgaaggatgccctcaagggattgtcagggaaattacactgaaggttcaagtgtgatctgtggaagaaaaggtagatttggttcaacaagccttcaaaccacctttggtcatctaggccaataccaaagtacagagaggagacgagctatgcctggggtcaccagccaggccaagccatactcgtctgggcctccccaggagtctggggaacacggagttgcctgtactctttgggaaagtgagggagcaggaggggccctgccatattccctctgccagcctggcctctcgcccccgacagcctgatttcagagaaggtggagttctttggatctgtcctgtgtcggggtcagaggcttgccctgagtttgtaggaatgaggtggccaccaggtggctttgttctcagctcttacccaggttgcggtgtcccccatctgaggcttgtctgatagtccagagaaagccctagaaggaattcagcacccctaccaccaccagcccccgagccaggcctggtctgggtcccagcgggtctgggccaccacggcacagatgcgcaggactccactctgtgcgctcagtcgctcagttgtgtctgactctgcaaccccatagactatacatagccaatcaggctcctctgtccatagaacttcccaggtaagaatactggagtgggatgccatttcctgctccagggtgtcttcccattccagagatcgaacccacggctcctgaatctcctgcatcaacaggaggattctctaccactgcgccacctgggaagactccactttaagctcaggaggaggtcagctcgggctgggtgtgcacggcctgtgcactggcctccaagctcctttcatccctgggtcctgcacactctttgctccagctcctagcacgtgccatgctcttccaggtctcccagcctttccccatcccatacctcttgcctggaatgccttctccaccttcagagcctcttttggatgcctcttctgctggaaagccatcctgacctttcaggaagaggcaggcactcattcctctggggtcctgtagctctttgtcctccctctttggccaacagaaagactgacacagaacacacactggcccttatcccatagacccccccccccgctgggtccatattccaagaaaaggccttcaagggccctccccccaaatcccaactgggacagagacccacagacccagcccaggtcttgcagagcaggctcagcctgtctactgcatgatggcaaaaggcacagcaaaggcgcctgaactcccatctcttctgctcctggctgtgtggccttgggcaacgcctgtagcttctctgaacttcttcattcccaggccttgccttgcccacttcccaggcccgtttggaagatcaaatgaatgaaggcagagagaatgcttggcgcgtgggcacagctccccacacagctgtcattatcaccgagtcattattacggacctgccttgtgcctggggggggcggtgcctccaaggctgggcagcaggcgggcaggcaggcgatgaactcagaagcagccgcagcctgggctgactcaggctgaggcactgggagaagtgggtgctttatggtcagcctgagccagcccagctctggccctctcctcctacccccaggcgtcacccaaatctgaggccacaaggccttccaggccctttcagggcctcttatctgggaagataaaggccccctccccttgaatggtggatctattcaaatggcttctgtgtgaccttggcaacagtcaccctctctggaccaggcttggggagttccggggtggggggcaggcagtgacctcaaaaggctcccagtgtgtcttccaggtgcttagtggggggactctcccactgctttgggccccagagggatggctcctgttctctccctccctgacactgacctgctgctgctgctaagtcgcttcagtcgtgtccgactctgtgcaaccccatagacggcagaccaccagactccgccatccctgggatcctccaggcaagaacactggagtgggttgccatttccttctccaatgcatgaaagtgaaaagtgaaagggaagtcgctcagtcgtatccaactcttcgcgaccccatggactgcagcccaccaggttcctccgtccatgggattttccaggcaagagtagtggagtggggtgccattgccttctccaggtgatggaactcccagtatcctccctagagtctggagttattatttttatctgacacataagaaaaatgaggcccagagatcaaaagaccctcacctaaggcagcacagtcaacagccaggacacaggcatgtgaccctgccagggtcttcagggcccacctactgcaatcctctattctcctgtggcctcctggctggcgacggctgcctctctctttccctccctggtggctcagagggtaaagaatcggcctgcaacacaggagacctgggttcaagatcccctggagaaggaaatggctactcactccagtattcttgcctggaaaattccatggacagaggagcctggtgagctacaatccatggaattgcaagagttggacatgaatgagctactaacactctttccctacaccctaggacaccagctctatgccaaggcttggacaacagtcaccaacttatgagatcttcacatgaatgtaagacagaggaggaagtcaaagctcagagagctggaattgcttggcctggtcacacagcacagtggtggctggaggctcagtctcccatacctctgctctgtgccctagaacagctgctaccccaggatggtaggggtttgaccaggcctcagggagcctgcagggcagccctctggtttcacagacaccccctggctatgggtgggccaaagaggaagggtacccatcctgccaggatggacctaccaggcccacctgggcccgacgctccttgccaggctcagatggaagcatgaggtcattgggccatccctgctccctgttggctctcgctgctgtgactcagccctgtcttccccaaacctccttctccagggaactctagcaatggtctggcctggccaggtctgctcccgctgcctgtccaccctctcagggcctcccagcctgagtcaccgctcacctcaccacctggcacaatgctcaccgcataaacagactattcccctcccccaggctcccagggttcctctccctacagcccaggagccaggctgaggggtgggggcacttttcctgctgtccccagacttcggccctgaggtccatccccagaacctactttcagggactctctggccttgataggaaaatctagaattgagattgaggcctcagcccagggctcagactgacctgggctcaaatcccagctccttccttgttaggtgggtgaccttgtacaagatacctccatttgaaggagggcaacagtaaaaccagctgcagcccatgaagatttcctacagcatcaccgaggccaggatcctgcttaaaaatgcaggtggctctagattcaaatggtggtatggcctcgcgtaagccactttgcctctctcagcctcagggtccttacctgcaaaatgggaacgagaggaagagagccctcctgctgtggtgactaaatgtgataagacatgaaaaaggtcaagccgtgtctggcacccagggaccaaacacgggtaaacgtttatgtggataaacggtagctgtaattaaatcttaaagtgacgtgtgcataacacatagctcgtgggaagctgccacatagcacagggagctcagctcagtgctctgtggtaacctagacagtgggatggagggggcaggcagagggagatccaaggaagaggggatatatgtatacatatagctgattcatttcactgtatagcagaaactagcataacattgtaaagcaattataccccaattaaaaaaaaaaaaagtgccaggcgttaagtgatcccaggatggttttaatgaatgatggggagatggagagcaatggtctggctcttcactggatgatggagtagcatcagggaacggcttcccaggttggaaagctccagcatcccctctgcaggttgaccaccccacttcccttagtgggtccagaaggctctctcaagagtctttctggctggggctggcctcacagttttccagtttccaggccactcaagaagcacttcactttacagaggacaaagctgatgctcagacaagggaaggggcttgtctgcagccacccagctggaagctgagcccaagcctgcacttccgtgttccccttcttcccagcctgggagctgcctccctggactggggataccctcacctcccagtctcagagagcactctgggagagtctcagagcttgtctgcacactggagactctttatctttgtctctatcttcccccgtaatgctcgagaggcagctccttgggccatggggccagtgaaagaggagaggacccaggagaaaacttctgtgacctcctcatttccagttcaacgggtgatgtgttgagcatgtgatctgaatgagggaacagaggctgggggaggtcgcatacgtaaagggtgaggggatagaaataacactgaccctggggtcaaacagacctgaattcaaaccccaaccattacacgtcaagctctctaacttctcagaatctgaagttgcatctgaaagcagatgccttgagatgcctcaaagggttatgctgcaaagatgaagtgagagcaagagtgtgaccaggctccgtaaatagggatgaaagtgaaagtgaagtcgctcagtcgtgtctgactctttgcgaccccatggactgtagcctaccaggcttctccgtccatgggattctccaggcaagaatactggagtgggttaccatttccttctccaggggatcttcccgacccagggatcgaacccaggtctcccgcattccaggcagatgctttaacctctgagccaccagggaagcccgtaaatagttatagtcagtaataatgatggctaccaccgatggagctcttcctcatttaatccttacacagccatgttactgtgattatacccattttacagatgagcaaactggagctcaaaaaaggaagaaagggcatatgtgatggggaagaaggggtctgacaccagaaccagagaccttagctactagccagccctcagagacataaaataaagcctagccagaggtggttatgggcgtgtgtgctaagttgattcagtcgtgtccgattctttgtgataccatgaactgtagcctgccaggctcctctgtccatgggattctccaggcaagaatactagagtgggttaccatgcccccctccaggggatctcctgacccagggaatcaaacctgcatctctatgtcacctgaattggcaggcaaattctttataccactagtgccatctgcaaaggtggctatggatgagaatattgtgggtgttcagaggtgagttagatctcatgtcttggatggagttgggaaggctggtccatggggtcacaaagaatcacacatgactgagcatgcacgcacgcacctgggggaggcaacctttttgatgggccttgagtttgggcaaaataaatcaagtaagaatggaaggaggaggaaaggcccaccttgcacagaagttgggaggcgagaaagtgtgcagtgtgttcaggaagtgacaagcctctgggaaaaggaaggaaagacaggtccaagtcaggtcccaagcaggccttatgccaggtgggcatttggactgaacaagatgcttcacgctgacaccaggccaggtcctggctccagaagcctggttttcataggaaggcaaattgacccaagtctcaatacccctcatgtctgttgtggcatcaggtactgtgccaaggcaaatgtgggtgagtggagcaagccaggctggccttgggcacctggagggactgtgtgacccagggcagtggaagggatgctcgtggtgcagctggcacatggtgtatagattcacacactttctactacatcccccccaacacacacatgcacacatcactcttttgcaggagtgtgtccacaccaagaggcccacacacaccctgcagcctgaggtgagggagggagagatagcagaggcctgctgaaagaaactcctgtgccaggcaatgggccaaagcgtccacgagctctgccacaaagcctccttgcggctatgaggtaggacttttcttcttaggagtctcggatggatgtgacctctgatactcaggaaaattaaacagtgctatacgcttggtcccaaggttggtgagcagcaaaatgaaagcacagactggctgcccctgccctgagctccgtagggcctgacacagtgctgggcactggggataagtggaggattggagtctgagtcacagggctttgaagctggcagccagagcagcggagcctcagagattccaggggtgggctggcccctgactcacccccacaccctgaggctgccccaggcagtggctttagctcctggccgccctcctgcctgccagagcccagcaaggcctcttctgagtctgtcatggctcaggattcccaggagctgggcgggcagggccaaagcctcaaggcaaggaggtatcctgggcacacctctgctcaggtatgtaggcctagagtcacagtgggaaccccggacctcaccagcctgatgtcagaggcaactaggcacttggggatagctgttaaatgaagaatgaaatactgtatttctgcatggcccagactccgggtggctcaccccttcccagagggaagacagccgcctggtgaggtgctgggtgcgccctggaaagtatgggttctaggcaacacggtgggtgtgactctgcaaaaccaccagctgcgtgtcttggctggtggtagtggagggaggagaaagctggggttccagcccctccaagtgcaggggcctcagagatgagaatccaggcattctggatctccaggatctctggtgggctgttccttctccctgtacctcagtttcctcatctaggtgtaggccaagggactttccctctctggctgcctgtcttttgcttttagaaattatgtccaagccttcatcgttagagcattttgaagatgtaatcaggcagaaaaggggacataagtcttcttcatcttaagcggtgtctctgcaagggcagttttgtctgatgagattaagtcatcttgtatattcactccagccttgggcctggaccatgtgcccaggcctgtgtgctaggccctggggttgggattgcaaagaagactgtgtctcagtgagttcataatttggggggagagacacctctcccccagaaataaccagatatttccaggacagtttaacatgcctttcaaagctctttgacctttccaatatctctaaccacatctgtcatgatggagaatagatgggtgagagattggttgtatagatatatggatggaaggatggataaaatgtcagataatggataaatggatggatcaatagaagggtggatggatggctgtggacatgggaggttgaatggatggatggagggagggatgaatgggtgagtaggtgaatagattgtgggggttgggggtgggaatcattgaatgtgtgatttaggttcctggtcccacagcagatgaatataaggggaaagttccagtcctgcctcttgttcattgtgtgaccctgaagaattcacttctttagctgtagagtgagaatctgtctggaaagacctcacctatcaagtgagagtcatgagcccagcctgcatcccaggtctgttgtgggtatccagtgaaagaggtatggactgcccatgcctacataatggctgtgatgagtcctcagtcagtggcctcacaggcaccggcaacgtgaggtgtttttgctgagggagtgacgcccctctgtggttgctggtgtgttcctaggcttcccacttcctccagcctgcacagagttctctgcccagttaggagcaaaggaggtgacctctgcagaagtgttgctgccagaggctccccatacgctgtacttgtcaaggagtaattgaggtgtcctgtttgttattcatctcagggtaagagtaggctcagcaagggggcacccagggcttgggattagggctttggagttacatagatctgccttccagccttggctctgccacttcctagctgcctgacattggacaaggcatgagcctcagtttccccatttataaaatagtaacaaattatagtacctaccccttaggtaggttatgacaattaataagcataacttatgtaaccacctaacatagagctcagaatatattaaatgcatgtgtatccaagtgcagaattgcgcccttagaactttgaagaaaagtccaaaacttcaagtctagagacctccatcttgaatgctcagtccttggattagtttccttatttcaaaatgttcagtgggactgacattcttcttgacaagtgtgccttgactgaacagtgtctggttttggctgcaattccaggagttccatgggcctcgctgaccctgtcctgattacccttaggttaatagcagactgggcacatgaattatccctttaaaagtggtttgtgtgggagctacaaatctttccaatgggctgagctgtagggaggaggagaatttagaagggggtgtcctcccggggaagccgcaaagaccaggagagctggtcccacaggaccgaggctactcttgcagagacccagtgtggggacgatgccgtgggcggtggcaggccctgctggctcagggtgagctgcagccgatggcaaggggcccagaccacccaccagaaagaggccctgagtctgagtggccctaggcttgagtgggggcagtcctgacctgtagccctgaggacataactcgggaacaggtcattatgggaatgtctaagctccctcagtcccgaaatccccaactcaggctggctccggggccataccctccccagacccccattccttgcagggtccagatatcccccttggccagccccatctgcccatctgctcgctctgctatatgcctgcatggtatgtgcctgcgactgagactctgtgtcccttccattgggactgcaatcaagagagcttcctgaaacctggtggggccaggtgacaacagggaagtggctggttttccagaaagtgaaagagcaaagggttccaggctgggagcaggagtgataacaatgaagtcacagagtctgcagagcttgcattttgggagctggaaactcagggcaggttgattctgcctgtcgtaggctatctgagctgagcaggcccctcacagtcgatgggaagagaggaaagctgtccagggaagccaaggaagggacaggacttgcccaaggccacacagcgtgaatagcaaagctggggacaaagctgcccactgctacaacatcgggtagctgctccagccctttcctgccctgttggacatcatcagaaggatgtttaatcctcgctcctgtacatcctccatcccatgccactggacagctattcgatgggaccaaatttatcattagtacaggggcaatcaaaggagctttggggtccccaggaaggtggcctaggcccatcccaatgtccctgccttcctgccagtgggatccttcctgacagcccttctcaaagggacccagtgcggctcagcttggacccctgggaactacactggtgtgcaggaaagggtgagtctggattagtagcccggagagtgtgtccagcccatcactgtcttgggcaagttgctcctcctcttggacctcagttatctcatctgcccaatgggagtgaaaaccagagagaatttctagaaggcagttcctagcatggtatatttcttcacccaaaaatacaccccaactatcctcttctgccagcccgccctccccacaaatctctgcttcttggattaggctggtgccaagtgtaagtgaagcaaattagtttgtgtgcaaatcaattcctccagcttctgacagggtgatctcctgtgaatccctgtgcctcagtctgcagcctttaccaacccaggcagggagcggggccaggtggggctgaggcagtgcagcagagcagctggtgggggcagtcagtaggaaccagagcaaaggagttgagggcccatgcagccaggtcagccaggaggcatagaggtgactgtcggggcccaggcctagagacctagggtggatattcttgttgttcttgttgtttcttagttgctaagtcatgtccaactcttttgtgaccccatggactgaagcccaccaggctcctccgtccatgggattctccaggtaagaatacaggagtgggttgccatttccttcttcaggagatcttcccaaaccagggatcgaacccacatctcctgcattggcaggcaggttctttaccactgagccatctgtgaagcccacgggccaggaactaaaggaaattcatgtgtgtattggaacagttggcttgtgcagacagaccatgatcatgtcaaaggcaagggaagagggaataaagaaaactgctgtttttaactcggcttgattttctctacctggaaaccaatcttgccagtgaggtggtgctgttcccggaacgctttcagccgctaagaccggggttcgctcaggttcccaggtccggcgtctccatttcacaggagccctgctcgcccggctggagcagcgggcagggaaggagggaaactggagttgggcgcagcctcccaagctgaccctgccaggccgggcggtggcccctgtcctgtcgtcatcctcctttcacagcagagagggatcctgtctcctggtctcgttaattcttctatcatgtttcccagactcggagcctctggttgcctattgtcctgagcaggcattttgcatttatgtaaagattagacaggttagaaccttcgctctcactccgatggtcttttttactttctcaaatccaagttctttccttctcactgcgctctgcttccttattctctctctctccctacctgtctttatcagcctccctgtttattttcttcccttccctgaccccctccttctccccactgacctgcttttcctctgtcctctcttcacagttcagtagtttgaatcctctttctcccccctccaccaccgccaccacaaccctaaccttgcttaattccatatttatcttctcccggagcctcatagaaatgactgaaagcattgctcacctcattccagaaataactcttctaaattcttagagaggcaccgcacgggggagggtgtgagcactggacagggagtcactgtggtttactggagagaacaagacccaggttcctctgtgggctcttgggtacaccagctgtgtgaccgtgacaccgctggcctctggccagtctctgtttcctcccaggcagcagtggagctggcacccagatgagaacagctgtgtgtaaggttgtgaaggagagaggacggtggtgccctgcacacacacttgtgctctgaaatgtttttcctgcttccaccgcagcctgagccagtcggagggaaggaaggggatgctaactggtatctccctccttggttctgctctgctctacagggatcacacatgcgcgcacacacgaacatgccctgggaagaaacaaagctgtttcttcaccgtcatctatttctcccttccaaaatgtctaatggtaaaatcccaactgaacacaggagcaaaaacttgggctttagtgggttcctgaatttctccatttcaaatccaggccttcattcattcaccgccccctccctcggacagcactcactcagagtctcctactgtgtgccagacgggctccagggctggccttctctggagctctggacctcgagattgttggggagataagcccaatgtcatgagtcaggcatgagagagagcacgggttctgggagttccaagaaatgagagggcctttcctcttgtgcctggagacagggtccctgagaaggagggactctgagccagccgaggggcaggagcaggatgctggcccccagggagcccctccatcactctgccttttttgcagaaagtcacagaggtgagccaagacatcctgtcctggccaagatgggaggttttcccaggggcttttggtgtacatatccacaagccacctttctggaaagggctctgagggccccttcttagcatcaaggaaatctgtgggtcacataggttaagaagaaggaaagaagggcacttcctgggggaggtggggaggaggcggctccaggctggtcagtggtcaggggtaaactgtgtccttccctaaggaaagcaggcccagagaaggctctgactctcccaagtccacacagccttgtaggtcatttacctcccacgcagcagaagggacaccctccacctggttgacagtaggcagacaggaaagcagggtctcctccaaggaaagggagggttttgcccatgggacctctccctcccaactctgagctctgggcaagacccatggagagtggggaggggctcacggcatttggaggatgacttgagggggtccagtgggactgaaaggggtccctggggacagcacgggagcctcaggactccaggaggtgctccaggctcagagggagcatcctcccccctttttcctccctcatcctgccctcctccctaccgcagaggctggggcgggccgggcgccctgggaggaggcggtgtccctggctccctgcccaccggtgcagggctggacgggcaggggcggagccatgcctggtgttataagaggcagccagggcaccgaggcaatgagctgtcgctcagcttggcagcaggacgctggcagcaggcacactccgcactccagcccagcctgagcgtgcctcaccactgtggtcgccatgcccaccgccttgtgctccatcgctctagccctgctcgtggccctgcacgaaggtgagcaccccccacgggctcagcagctgcagcagccccgaggctgcttgtctgtatctcctgctggggctctgtgccccccaagccagccgggggccttcaggggcaggagttaggtggcttgggggctgcaggaggctgtgctattagaggtgctgccgtcccaggacagccaccggtccttccaacccagagctgctggggcttccccaggctggcccagggctcctgagcactgagaatgccaacttcctcgattatgcaagaggaggagcccagcgggtcccccatcccagctgtgccaggcgccctgacccacctctccacttttctctccctcctgtgcatgcaggcaagagccaggctgctaccacccccatcccagagcaaccagcgcccttgccccgggcccgaggctcccacctgcggactcgacgttgctcctgcagctcctggctcgacaaggagtgcgtctacttttgccacctggacattatctgggtgaacactcccgggtgagctactggagggatccaagaggggttgcagggggcaggggtggggaatgctggcatgctggggaagccctggcacactgcagctctctcttggagtgtggggctaacaacaatagcaatcagctattgcttcagttctcacgtgggggctgcctgagcaagacagagggctgtctcatgaaaatcctcacaaaaagcctggtcagaaagtgttggctccattttccagatcagggtactgaggctcagagaagttaggtgccttttccaaggtcacacaggaagagtaagtggtaggtaggaggctccagcctaggtctgcagatgccagagcgcacagcggctctgccatgctgcctctgtataatcttccaagaatgatatgattaatgacagcacccatgtcttgactgcgccaggccctatgccaagcactgctggtgcgttatcacctcgtgaacgcacccccatcctccccagtgaagcggggactgctgctgtccccaaatgacagacaagagacctgccccatgtcacctggcagagccggggtggggtcccagagctgtctgttctgtctgcacccgcgctgcctccgggccactgcatacttcaagttgaagtttctctgtgtgtttgtattttttttttccttctccaaattgcaaaagacaagagaagcccggcacgtaagcgtgtgtggagctaatccgcatccaaacactggctcagggcgggaaccctgccagtccctgcgtgctgggtctacctggagtctctgcagctccaaccacaccgtctaaaattagctcaggcatccgaggtgctggtctgaccggccacggggccctgcccttcgcctggcccgtctcagccagacggaatctgaaatcgatctcagccaatctaatatatctatgcacacacacgcacacgtgcaggtcaggcacacgcaccattttaaagtcaaaactctaagaaacacttgggtcacccttccaggcaagtggtgaccggatggaggcagctgagctgtgagcctgagtgttcacttctgtgagagggcactctctccctttcttccagactagttgggggtcttctttgagaacagggggaccagcctgactccatcagttcaaattgctgtctgggagtgagaggggcagggaggacagcttccacccctcccccccatgctgagcgtcttactgagcaggaccagggcagttgggagggaacagaggcccgagagggtaagggtcttgcccgaggctccctggcatgtaaggaggaagctgcagtgggaattcttgagggcaggagctggttacttttgctgccaccctggtggcatggatggctatcccagtgtgcagtgtggacagtcccagcttgccaatggtcctggtttatctaatcctctctctgtctctctccaccctacaccactaccttgctggcggcccgcccacagacagacagctccttacggcctgggaaacccgccaagacgccggcgccgctctctgccaagacgctgtgagtgctacagtgccagggaccccgcctgtgccaccttctgccatcaaaggccctggtaagtgggcacccagcctgcaaggggccagaggtgactgctggcctggacctgctctggagggcagggtgtctggaaggccagcagtggcggactgttagtccctaggtcgtgcccgactgtttgtgaccccacggactgtagcctgccaggctcctctgtctatgggattctccaggcaagaataccggagtgaattgccattcccttctccagggtgtccaggaggccagcagaggcgtggctaaatggtggaggaggggccaggggagcagggtcctgggggtccagaggctgccctgggctgtggggcagcctcccttcctgcagggagccagtcacccttgagtcttcccccctgccactacccccagctctgggggcttctgagaccattgcgtccccactcctgggcaggaggaatcctccccaggtgatagctgaggcagcacaggtccagagaggaaacaggacttgtcctgtcaggctacacagccagttagacgagagctgggccttccgccttagtcgctggggctctgggacctctggaactttctcagtggagaagcagtagctggagttggggggccatggcaccgtccccgagctgccacaaagcgcctttgccagtcttttggccctctggacctccctccctccacgcggagcgttgggaaagcagacagtgacttcaccctcccctacctcccgctctcatgaaggcctatgggaaactcctcccctgagacctcagctgtggctgcagccctgcctcagtttccctgctgagggttctgcttggctgcaagtggccagactctgggaaggccagccaccccactgcctctttctgaggctgagaacgcattcccagtggctcagttttcctcaggccccaccccacctgggaaaagaagggtgccaggtgcacagggtggaaatggatctgctcctgagggcgggtcggggcggggggctgggctgggcctgcagccaggcagcctgggggccctggacagcccctcacttgggccctaatgctgttcactcaggactgatgcggtggcagtcccaggcagcgggtcccctgcagctgcgttccaggatggcaagacacaggccacagcaggagagctcctccagcggctgaggtgaggggcccctacactgattgagtgccttctgtatgccttgcacatttcccttattctccatatgacgccttgggtccttatggggcagccaatagcagctcagacagatgaaggtgtttacccaaggtcacagagcaagctacagcatctggctgactcaatagcctgtgttcttaaccactatgctctttgttaccgccaggcctggaagtggacttttattgagggtttcaaggcttgtgactgtggaaggttcccaggtgttcattcaggctgtgtctgaatcaagcatctcccacatgctggggtccaaacggatgctacccagcctgttccctccctgggtcccagactggactgtctccctggtagctacaacatggctcagctcaaggcttggcatccaggaggtgcccatgaacgtgtgtccaaccaaactgacttgagaacagaaacctatagccagtcatgtggcagggtggctgaaggggcagcatctgagctagaaagtcccagccctgccacgagcaagctttgtgaccttggtctgctcactgaacttctctgtgcttctggttcctgtctgtgaggcagggacaccgctgctatccatctcacgggcttgttgaagtttagagcagttgacatacatgaagagccccaagaaagcccaggccctacgggagctctgaaggttttagccatcccgaacctctgtccctgagggttcctcagggctgcccagggccggggtgcagcctagcccctcaagggtccacatctctgtgaggaggcggaaacataggcaaaaagacaggatggccggctaggcaggacccaggatatactgaggaactatcttaaaaaaataataataaaatgaaagtgttagtcactcagtcgtgtctgactctttgcaaccccatggactatagctcaccagactcctctgtccatggaattctccaggcaagaatactggagtgggtagccattcctttctccagaaaatcttcccaacccagggatcaaacctgggtgccccgcattgcaggcagattctttatcatctgagccactagggaaacccaggaaatgtcttaagatgaaaaacttcaaggtaagactttgcaagtacttggcattccataattagcaaagagtgttttcgccagtctgtactcagcctcacaccagttcaggcctgtgtttattttacagaccaagaagggggttcagagaggttgagacccttgcccaagttcccaaagctgggaaccagcctcccagttcccaggctagaacgccttaagccagagtgaggccacctagatgacggcagagcccctaccagggtctcagccagattcaaaggactgctaggatccatacatatctggagctggaccttgaagaatgggaattttagggcacggagtatggggtgagtggaaggtcaacagcctgaagagccacagggatagaggtgtggaagtgagagggcaatcaggggagagccacggggctactcttggccgtgcagtcaccctggtggcacttgatgttgagcatcaattttgtcaaagctccttgtgggcagaaaagcttctaacctgccccggcctctccttgaggttcagaccttgttttcagggttggctgtgaccaccctctgacctcttggccatgaataaggaatccagaccctatgaccgctgcctctcatggggaactctcaagtgatgtatatctccagagatgctcaattgacctctttccatttcagggttatttctgcaaccaagatccactttgctaggcaacagcagaagccgacgagggagaccagacctacacactccaggcagaggaagagatagctctcgactctgggagaactttgggaaggaagcctgtgtggatacaggaggagaggggcatcccagagctgggagaccttccgacctgtttcctgggccagaaaacccagctgctggagcaggcacaagctctggcctcctcgccctggggagggggcctcgctcaaggcagctccgtgacaccaggaaagtcatcaggccccaggctgcagcgtggcctcccacactggctccagttcctaggccctgctgaaaggaacggcatgcggaatgtgctagcctggaggtgtcctgtctggcggctgtgaaccaggaacaacgtgcagtggcgggcactcacacccaagccagcccgagtccttccagggttgaagtcccggccgcccccgacccctcacccccgctctgtcccctccagccctcgctctccagtgtccttattctcccttcataccctcggggcactcttggtgagaagggcctgcaccacttcacctgtctgtatataacttatttgctctaagaaatttgacgattccgattatttattttaacgtatttttttagactctcaattatttacctgcgaacttgtgtttgtaataaacaacaaaataatgctctagcatttggtcttggttgagcaggaggtgggaggcacttttcaggaaggggctacttagaagtgaagggaacaaagggacggcggggaaagagcctgaggcaggtgtggagcactgagttccacacccctgtgccccggctgggcatcgctggctgctgacccaccctctctggacttttgcctatcatgtgcctagacagccatttgcagctttgatatcccgggttccaggacctgtgtttctatcaggccggtaagtgttggccaggcctttccccagagcatgtttcataggagccaagactataaggacccacttctgctctggttgccacccctgaggttcagagcaaacctgtccagtgagggctgtgtgctgttccaagactgtgtgcagccttactggccagggatggctgttgtaacggagtcacaggctggtccttatccctcaccctgggcttggacagaccccgctgggggcgctcaacacttctctcactaaagaagcccagggctctagcactggcttggctgatcctgccaaggccccaggaagctgctcacctgagtcccagggacagccagaagctacccccgctggcagctcctgagacctacagcctccactgctgccaaatccccctgcgaacaaactgttccctttcccctggccggcctctgctgggaatggtacgctgtggcctgagccagttattgaaaaataattatttacacactactctaagcctgccttgtccatggagccagccccaactccctcctgggagaagaacatgttgacgcatattgaactcctactgtttgctggcattttatgcagataaactcacttcatcctcatgacaatcccatgatatagatacttttattatccccattttacagatgaggaaactaatgcacagagaaggcaactaattttcctggggtctcgcagcaagtaagtggtagcatcaggatttgaacccagagtgtatagtacacatgtctatatgtactgactaaatatttgttgattgaattcatggattaccactgtagtatgacattgaacaaatcttcctctttctgagcctcagttttttaatctataaaatgggaaacagtactttccactttgtagagctggttgtgaaccctaaatggatgagttatggtgctgggctcagtcctgggcctgatgagaggcaaagccgaatgtcaggccgttagaagtgatgatgtaacaagagggacaggcacaaagctgcaggacctaagttggggggagattggggctggctggtgtgcagaggcatggtcagagaaagatgcacgactaaggtgccactcccacagcctaaggagagtgagactcacatcaatagaaggaaagtgaagagggagccccagacagagcagacaggaagggtaaaaggttttggcaatgggagtgacaaaggggtttcccatggaggaccccatgtggctggagcatggtggggagagagcagcaggagaggaaaccaggactccctggaggccaaagtagggagcctgcactttctctcatgggccatggggaccctcgaaaggtctgtgggcagcagggacctggtaaagccagactttgaaaaaatgccagagggccacacagggggaccctgaatggggagacagaaggcagggaagcaagtcaaccgctggtccttagggatccagcctgggtggctggggttggcgatggagccacacagtcacttcctacccaggattccggcacacctctgaaatctcactgagcctaacgccaggtgaatctcactccccagcatcctgttcaaaataaccctgcccccacggaaatcccaaagcaacggccaacagtcaggctaggcagtgatgtggggcaaccccagcatggcaggagtgatcgagaccaggtagaggaatgtaggttgaaggtgtgtccgaggcccagggaattaggcattcactgccctggtcagagttcagagatcagcgaccaaatgattaagtaagagacaattagagggaggcccagaaggcaggtgaaggcaaggcgataccataacccccaggatccttactctcaagaaatgggggcccctggcttgggccctgcactctagccctctgccagccatatctttctctccaaataagaagtttgcagggtgaagggtcatgaatacccaaagtctgagcctgcttctaaaccacattccatgcagcaggggcctcagaagtgtgggggaaggtgggatagagtttggaagaagcagaggaaaatttatgaagaactgttgccaaatcaaactgaaccctgggaagaaaggtgtcaacattttagaaagcatatctggattttatgggacaaaatcgtccctttttcctgcctttttctgccttttccataaatacttacaggtttggtttaggctttctgagttaaacttgtgttccttttaactggaacaccaggcggagataggccagaagggggcacagggtgacccagatttattcgggtcatgtgcatgcatggaagcagagtcagaggggagtggagttccatgtccaggactgtgcagcctgatacatatccaggctacagactggccctttcctgtcctggactgcctctccctccactctctcattcagcaaagaaccccaaggaactagtttcactcttgccatctcactctctctctgaacctcagggatttcaattgagaaaagtcatttgcctatcagggcaatgaatcattggagtgtggccatccatgcgttcaacaattatgaacaatcaccgttcagagactcccgtaaacaaggcagacacagcccctgccctcacaggccaagaggagagcctttcaataaagcactgttactatgaaggtagaagtgaaagcatttattgagtgctcatcaagctcttcttgcacatggattctttggatccttgcagcaaccttacacagcaggttctatcatcgctattcccagttgagagaagagataacggaggttaagcagctcacccaaagtctcatggctagcatgtggctgagctgggatttaaatctcaggctctcagcctgtctgctgtcctgctgctctaagcaggtagatccatacatagtgtgattgagcccctcgggtgggagagtctgggaggcttcctggaggaagtgacagttgatcaagagaaggagcgggtggacagagtgttcaggcagggggaacagtgtgtaggaagggagctatattctctgtgcttagtcattcaatcctatttgggacctcttggtctatagtccgttaggctcctctgtccatgggattctccaggcaagaatactggagtgggtagccatgccctcctccaggggatcttcccaacccagcgattgaacccaggtctcctgcattgcaggtggattctttaccagctgagctacccaggaagcccattctcagaccctatcagggaacaaaagaaggaggcatggggaagactggagaggggttgctagcggggtcgggggggtggtgggcatgcggctacaagcagggaaatccacagctgctgtcacctcacccccaatctgtgacagcctcagacaatgtccccctggacaatattgccatgcctgaaacacacctttggatcaaaccgtgcttgcgccccttggggtttccctaggctggcaaggaagacagacaaggcaaagtgaagagacaggaggtggataggttacgggctgcccttccagctgtgtgcccttcctgtctccctgggatctctgctcatttcatcccaggggcgttgtgggttcacagggaaagcttggggaaggagtagggtttgcacacactgggatgagggaaacagccggagcatagaagaatccgaaaagaggcagcaagcctgattggcaagggccaggctgggaacagcatgcagtgccaggaatttgaacttgagtgacggggagccagcgaaggtggctgatcaggggagagagccaggacaggagctggccttgggcagctggcttgtcctcggctcttcctgcctccccggccagtgcttccagctcaagggggccctcccagcccctcgcaggagagacaaagtgtgggccttgcctccgcctgccagggaccggagccaagagccctcagcagctcggaagggggccatgtgcgggcccgccaggagccctggaagaggaatgtggcctaattaattctccaaagctcagagggcctcgccttgtgggagcagctgccaggacaggcctgccaggacgccacaggcccagcccgtctatcattcagtgctcggggacagcaggctggaagcctggagacaggggcccagggggccagccccttgcctccaggtacacacgtgtcctccagccccttaacagaaaatagtgcgataatagtaataatcgccaacaggccttgagggcttaaaggtgtgtcagactctgtgcaaagcctgttatactcacttctcatctattcattacgaaggaccagtgacagggaaactgttaccatctccattttgcagatgaggaaactgagggacagatgggtgaatttccctggccgaaatcctgcaatcaaaaagcacacgcagggaagctaggattgggatgtaggcagcctgggccccacaagcatgttgtcataagcactgctgagccagcccagcgaggacatggaggcccagggtggagcgatacctttcccggggacagtcgactaaaaacaggccctgggacattgaatagggaagaaagaccacacccctgtcctctgcttgaactgcctcctcctgaagtttctcatagggcttttcctgtctcagcccgtaggtcatcctcaaagacatgtgactcgctactccaggcagatgggctggaagaagacatgccgtctccctgggatccctgctcatttcatcccggtggcgctgtggtggctgcactggcagctgggcgaggtggtctcacagcttcctcctagcccgctttccatccgtccacggaacacatcccctccaaggcgggctctgaatggtgcagggacggctgtaccagggccttccaactagaaagtggcagacccaggagaagatgggcacacagactggcccgaagccaagactctgctcttcctcagcagcagagcaggaggagggcagtgcagccacatcgcatcccctctctgggcctcagtttctcatctgctgtatgggcctaagagcattaactgtatagtcttgtcctgcattcatgcaggctaagttgcttcagtcatgtccgactctgtgcgatcctgtggactgtagctccccaggctcctcaatccatgggattctccaggcaagaatactggagtgggttgccatttccttctccagggggtcttcccagcccggggatggaacacatgtttcttacatcttctgcgttggaaggcaggttctctaccactagggccacctgagaagccccatagtcatgtcctggaactcattcatgtgtcaagtactgtccgaagtagtttacttaatttttaaaaattttccaaagcaaggttttttcatagctttgtaacatatcaccataaggctgcaccatatgcatctgttactctgtaggtgtgtattttagtttgtcccatttccctccaatgcaatgtttacatgtgtgctacatttatacacaaattttatattcattcctaattcttttttgctgcatattttttatggagacataatttacaccccataaaatccactcttttaaagtgtacaattcagggtttttttttaaatatattcacagttatacaaccatcaccactatctaattccagaacgtttccatcatcccaaaaagaaacacctcacctgttagcagttgctccccagatctcacttccccggcctctgtacaccacaaatctactttctgtcactatggatttgcctgttctggacattttatatcaatggaatcataacgtacgtggccttttgtgtactgctccgttcacttagcacaatgtcctcaagatttgtctatgttggagcaggtgtcgatacttcacgcttttccatgactgaataatattcccttatagagacagatcaggcttcccgggtggctcagtggttgagaatccccctgacaatgcaggagatgcaggagatgtgggtttgatccctgggtcgggaaaaacccctggagaaggaaatggcaacccactccagtattcttgtctgggaaatctcatgaacagaggagcctggcaggctacagtccatggggttacaaagagttgaacatgacttacaactgaacacacacacacacacagatcacattttgtttatccatttgtctgcgttgtttccactcttttggcttaagcactttactttagccttcagtgaccctatggggaggtgctctcttttcatcatataaacaacaagactgacatccagagagcttaagtaacccatgcaggtcacttagctagtgagcggcggtggtgggctttgccccaagagtctggctgcagagacagtggcctcaaccactgagcatcactttctcttcagtcagagtaagatagtataaatcagcacccacagcaactgtgccaaaagtggtacccacagggcacttaacagagggtggcttttctcagcagcatttctgacactggcagagccagggtctgccaggcagggcctgaagctggagcaagagtgtctggacagccagtgataatagtgactatctcagtacacgggtggttcttccagcaatggggacatctctccacacttggtggggggccgtgggcactgactcctctgctgcacatctctggcctgcaccccagagcccatctctcctcccacctccacctacaaagtcatggctcccctcctgtccccaaggccctgacactgagtaaccgaggcagcattcttgggtgaggtcaaggtcagagctgcagtggaggctgcatggacccttgaatgggtctctgtctcctcaggcctccacctactaaataattagataagaaatcttaatacttccttttttaattacaaagcaatttaaataggacaatatagacacaaaggcttgtggctttaagataatgaaaagactataggaacatctaaaataaaatgtctcttctgggcctcccactccaaggcaacgactctgagagtggggtaaatagccttttttttttctatgggttcagatatatgttttctatctaacgttttagaggtattaaaaataatgcacggcaacataagtttctctactttacaaccttttcttctcacaccaaaggcatctttccagaccaatacaaggcttttaccacctcttaattttaacagctccacgtggcccttgttaaggacaggcagttgtcacttgactgtccacccactgaagccttttggatggcttgcatttcttgttttcataagcacactacagtaagcacctggtttatacatctttgtctgcagaggacagatttttagacacgaaatttctaggtcaaaggatgagcacattttaagtattctgccgagaatgagattccaatttgcattcttgttcccactgggtatgagtgcccttttcctcacaagccttccagcactgggttttatccatctcttatcgtttgctgccctggtagcaaaaccacttcttcataaggaatacgatgtgcaaaagagctttgcttgatgccacccagggtgaggagggtgaggggtctggagatgctccaatgtctcactctgtcccctggtgcaaagaactcctctagggacttccagcactgctctccaggattctgtttggctctagggctctgtctctcagttccactcaggggttggccctcagggagctaagaatggaggaggggctggccagtcttcctgctcagttggccccagcctcccctaatagatgtgtctttgagtaggcgctcctggggacagcatcatcatgggaaagcgtgtgtgcgtgttgggagcggggggactctgggcacctgaacctgcagatgttcctaatgggggagcctggggcatcctggttccctctcagcctgccatccaaactcacgttttggaaaagactgaatctggatcttgcctctgcccaggtcttgctgtgtagacccaggcaggtcactgtcctttctggactccaggctcccggctgccaggctgggggaatccctttacagggtagatgccgaatctgctccctctggagactccacactggccacaccatgcgcatgagtcacccccaagttggcaggctgagggcaggggaggggcatggaggcaagagaagggaggctcgctccagatgactttggtgccacatggtgagtctggcgcagtggagtcttgcctggctaacgtgagtgtgtgagcacaggcacacagggcacaccgacgtgtgaagtgcattcttgtataccgaccggggatcctcctgctcaagtctgggcattcaggtttacagctcaggtgatgagtgtccatacacaatccatgtgtgtgcacattcttgtgcgtgtcaacacatacacgcatgtgtgcctgagtgcccctgagcttgtaaatcttcacctggttgtggctgcctagatgtgtctgcatgaacgtgtgaaagtgttagttgctcagtcatgtctgactctcctctgtccatgggatttcccaggcaagaatattggagtgggctctctggggcattttcccgacccagggatcgaacccttgtctcctgcattgtaggtggattctttactatctgagccaccagggaagcccagatgtgtgtgcacacatgtgcctaaatccgtgtgcatgcgtgagggtgcaggtgagcctgcaggatgtgcgcacacgtctatgattagagattacgggtgtgtgggtgcacaagtgtcacaaacatacacactaatgtgtgcgtttgtgtctgagcacatgtcaaaacacatgcatagagtatccgtagtgtagatggagtgcgtccacatgtatgggtctagaagggcttcagtgtgcatatgggcacagctatgtatgaactattacagtgtaactctgttgaagtgaatacacatgagtgtacatttgcacccaggaggggccacctcagcgtctgcaaactatgacatctcctccagggcccatcccacctggcctggacctctcccctcaacccacactgaggaaccaacagaaggacagtgtcattgctttaattacaggaagactaagtattttagtaattagtaagtcattataaagcttactgcttttaagaacaaaaatggctatattatagatacaaaatgcatatggaatctgaacaagaagcatggaagtgcaggattttccaccccaatctgggtgggagggcttgaagaccaagtatacacagggctcaggaaggcaagggagggagaggccagagcagagagcccctgcctccatttccaaggctgtccacacctgacctccatccctacctccatccagcgagatatcgttctgggcccagagggccccaaccctggcctgagtggaagtcagggagtgagtgtgtcagaccacctctgacagcaaccagtcaaggcaaggcccttctcattctcccttccgtggcctataactctaagatagtcatacctacctgggttttctcaaagaacctcaaaatataacctccaacacgtgcctacctccttcatcctcccagaacaatttctacctcccacccccagctcctgtccttctctcttggcctgcactgcctccttgccacaggtctgacccacaaacttctactcattggtccaaaaccacgcctgtgtcaccacccagctgtacaattgtcatcccagctggactgtgaactcctgaggtagggaaggctcaggcattcttgggtccccagagcccacctcaacctggcacagcttagatatcactcactatctgattttagaaactgagataagaggagaagaaagggagagcccctgggcgcagcaacgtttggtaaacacggcaggtcgttgggtgccccaagactggatgagtcagcctgacccttgccctggaggaggaagaaaaagtgtcatttatcaggctccacctggtgccagcatcagccacacacttgatccccaccacacacctgagaagtaagcaatatttttactcccattttatagatgcagaaactgaccctcacagaaagtgagtcagcagcagagctgggactcaagccttcctgactcagcacttcctacaggctcatccccccaggttctttctctctgnnnnnnnnnnnnnnnnnnnnnnnnnnnnnnnnnnnnnnnnnnnnnnnnnntcctcaggaacagcccttaatcataaaggattggggtggtgggtagatacgccagctcacttgcaccatgggtggagcaactctaaggctgcttccacaccctctcccggaggtctctggaggggctaagccctgtttccacctgttgctcattaacttgtctgtattggctgcgcttcctttctcccttccacatcttttatggatcttagaaccacctcgaaaataaactccatgccctcgaatcttagtccaggtcctctctggggaccccaacccaagaccaaggggcagcagccacagggactgtgagtctgggaaagccagggggacattcttgcaaagaggcctcggccacagaggcccagagacacatgcaggtccagacccatgggatgagccctggcaggcgggaggccagcctgactgcagctccagagctgcacacagtgtcaggctggcgcatgaggacgcaggagcaccagggtaaagagggcacgggtgtgagcacagcagctgatggcaacggggtttatctcagggcccaagaccacacccacacctccctcccttctgcagaaatgggcctggaacacctgtgccctggcaagccctagggtagaccccggctggaaaaccccagggctcccagctggccttctactgctcagcacctctggcctgggtcctggcagagcagggaggctgcctggggaaggtcttagatggcaaatctgtacaattctgtgcctctctgtccttcccattcaagaaatggcacagggccttggtagggccgaggaagtgaatggagggatcccagcacctcagagggcccctgttctctgactctgccaggacatagtttgcacacagaacattagatgtggcatatcttgcttccccacgcttttcagaagagggtgggcttccctgatggcactagtgttaaagaacctgactgccagtgcaggagatgtaagagatgtgggttcaatccttggatcaggaagatcccctggaggaggacatggcattccggtactcttgcctggagaatcccatgaacagaggagcctggtgggctacaggccatggcatcgcgaagagtcagacacgactgaagtgacttagtatgcacgcacattacttaacccagaggaatcaagttctaacggtggaaattcaagcattggaaaagacatggcttgattttaggagttggccttccctcaaatcacaccatgtcaaatctcagacaggcagcatcatgaagcagaaaaggcacaggctgtagagccagacagacctggctcaaatccttggagacagaaaagcccctcatcctgagctttggcttccttggctgtgaaataagttgacagtgtccactggcgggagacctggcttcagtccctgggttgggaagatcccctggagaaggaaaaggctagccactccagtattctggcctggagaatcccatggactgtatagtccatgaggttgcaaagagttggcactactgagcgactttcgctttcactttcactggccccaggtaagcatcttcaatctccttcagtcctcagtctggtgaggaagtaactccagagatgagcagatgggcactaaggcggccaactcctgctcaggtgggtccagagtgattcagaagcctgctgccccctgccaggggcctctgaggctgggctgtgccctgtccacttcaccctccccctgtgtggcccagccctgacccgagactcacccactgcccggtttcggcacctggcccacagttagccagggctgggtcttcagtatcaacattcctctgggataaatacctttggcctcaggaatgctgggaactgggccaagaggtcaaagggcctggactttatcctgagaagctcttaaagcctcacagcacctagacgaggcaggcgtagcccagtcataaagagaaactgagagccactgatttcatccaagaaaagaaaccaggggcctccttggttatcctccataagaatcaggacagcagaagatgaaaaaaatggactcaaagcaagcaacagactggaaattccacttctgggtatttaccccaaaggagtgcctagatatgttcatctgaagatacatacaaggttgttcacagcagcattgtttataatagtctcatactaagtgaagtaagccacaaacagaaagacaaatatatgattttccttatatggggtataagtgataccccatatatcgcttatacaaatgataaaaatgaacttatttgatgaaaaaaatgatacaaatgaacttctttgcaaaaccgaaacagactcacagagaacaaactatggtcactggagggaggagttggacatcagcatgtacacactgccgtgtttaaaataaataaccaacagggacctggtgtatagcacaaagaattctgctcaatacagtaataacctaaatgagaaaagaatttgagaaagaatagatgtatatatatgggcaactaaatcactttgctttacatttcaaactaacacaacattgttaaataactataggtaggtaggtagatttagttgctaagtggtgaccgaatcttgcctgccaggttcctctgtccatgggattctccaggcaagaatactggagtgggttgccatttccttctccagggatcttcccgacccaagaattgaacctgagtctcctgcactgcagtcagattctttatcaactgtgctatgagggaagaaaactccttaatgtaattaactatagttaacataattagtgagtgaagtgaaaattgctcagtcacgtctgactctttgcaactccgtggactatacagtccatgaaattctccaggcaagaatactggagtgggtagcctttcctttctccaagggatcttcccttaactagaagttaattaactaattagaagtaaatataattaactatactccaatataaaatttaaatatatactagaatgttcatagcagcactgtttataatagtctcaaactggaaactatgcaaaagggcagcaacagtagaatgaataagtaaattgatccctggtggctcagatggtaaagaatctgcctgcaatgcaggagacctggattcaatccttgggtcaggaagatcccctggagaggggaagggcaacaaactccagtatttttgcatggagaattccacagacagaggagcctggtggggtccttggggtcaaaaagagttggatacaactgagcaactaacactttctttcttcagattgaactacaactgataaaatcatacggatgatcttacaaatgaaacaagattccatcctttaagattccgtatgtctatatctatatccatgtatatctatatatctccagttttagtggtgccagaactcagcaaagtgatttcccttgggggaatgagggcaggcagtgactgaaagggaactggaagggagcctttggagaagcagtcatgttccattttttgatatagcttcagggtgcatgggtgttcttgttttgggaaaatccttcaagttgtacatttatgatctgtacacttttctatatgaatactatgctcttgaatcttgtgttggaatcttagcgatatgccctcttctacgtatggcctcttttgtgcaacattgtatttttgacattcatccatgttgtgacatgtaacaagatttcttctttttcactgccatgtagtattctattacccgaatagaccacaatgtgttcatccattctactgttgatggaaggtgggttgtttatggtctaggagctattacaaattagtgctgctttgaccattttttgtacctgagttttgatgaataaatgtacatatttctgctaggggtatacctaggggcgggatggctagctcatagaatatatacatcttcagctaacggcaccccactccagtactcttgcctggaaaatcccatggatggaggagcctggtaggctgcattccatggggttgctaagagtcggacacgactgagcaacttcactttcacttttcactttcatgcattggaggaagaaatggcaacctactccagtgttcttgcctggagaatcccagggacagtggggcctggtgggctgcagtctatggggtcgcacagagtcggacacgactgaagcgacttagcagcagcagtaatgctttggaaggaatggtgctaaagctgaaactccagtattttgggcacttcatgagaagagttgactcattggaaaagactctgatgctgggagagattgggggcaggaggagaaggggacgactgaggatgagatggctggatggcatcaccgactcgatggacgtgagtttgagtgaactcagggagttggtgatggacagggaggcctggtgtgctgcgattcatggggtctcaaagagtcggacacaactgagtgactgaactgaattgaactgaactgaatgattttccaaaatgttttaccattttggacttccatcagctgtgtatggcagcctcatattctcactagcacaagcacaagcatgctttgtcttgtagccattcaggcaggtgtgggataatttgcatttccctgctgcctagtgaagttgagcacctgtcttagtttgggttccctaggtggcgaccctgagacaaggatttgagagcaagaagtttcttggcaggtgtgttcgtctcctaaggctgctataacaaaataccatagactggtgtcaaaacaacagacctttattttctcacagttctgaggctagaagaccaaggtcaaggtgccatccacgttcgtttctggagaggcctctcttcctgccttgcagatggttaccttctcaccgagtcctcacatggttgcttctctgtgcatgtatagagaggcggagcaatatttctggtgtgtctttctcttgccttcaatgtaaggacaccattagggcctcaggcttatgacttggtttaaaccttaattatctccctaaagacctgatcaccaaatacagtcacttgggaaggtagggagacgtgattcagtccatcatagcaggcgatcctaggaaaactcacaagggagtgaagaagtgacagcatgcgggaggaggctctggaagtgcgtgtccacaagccagttgccaccctgggcatctggagttgaatcccacggggagattctgagaaaccacgtaaaccacgccctcgagagttatcccactcagggcgccggggaggtggacttctatacatcgactcctgccggtcactggttgaggcctatttcaaagtatgggggtgtggggtgggggcggtgatgttagctccctggtgcctcccaggctcacagaagccctgaggctcggagctgcgggtacacaggccacagcacgtcctcacatgctagtaacggtcgaatcctcacttgagtgaagtggttactcttttgaagctgagttttgaaggatgtatacagatgggccaggcaggagacagcattccagcagagggaacggtgnnnnnnnnnnnnnnnnnnnnnnnnnnnnnnnnnnnnnnnnnnnnnnnnnnggtcttccagggccccccagtcctctgactctcccaaatcctgactatgtactgcaagcaccactgaatgccagaatgtctcccatagccagagacatagacgaagttcccagcagagaggctgcaagccaggtcggggccggagcaaggacaaagggaccagcgttcccagggcaacagaggctcaggccacaggatgggcatcagagaagtcaaggcagatctcaaggttgacattaacaaaggaccttgagctaaggtatggggtcctgaagccctgagaaaggcccacttatactcacccccatgccacctgagttcagactgtgctgatcctcctcagtgtcctcccaggtccgaaaagctgtgcatgtttacactgtctgcagagcctaaaccaggaaggcagagggtcagggagaggcgggcccagggctgtgggcttggatgagaaccccctaaccaccattttgacctgaggggaactgggaagtgggaacctaagacaggtctgagcaggctctgactgctctgcagagctatcagcttggagtccagccacatccagttctgtatccaaataacaggcatctcatctgcagaagtataacctggcagggcccaggcatcgtgagtatctgtcagtccagccacactttggcaagtcatgtcccccctactaatcctgctctgtgtggcttgggtggggcagtctccccacacccaggcggcgggcttgtgaaccatgcctggccaaccatgtccccacccccaggtgccgtgattgactcaaggataaacccaggaccctacccaggccaacaggagtctcccttgagacttttactagcgatgtctggaaactctctcatctgctgagatcctgagctgtaaagaagagatgggaacagctggtggacagcttgcaagatagagaaaatctgcccagaataaaagaaagaaagaaaaaaaaaaaaaaaaaaaggcaggcctagctggaagatggagagagagagaaagagtctttgtggtgtcaattaaacacctgggtgcagcatgtctgaagttcctggactcctcatttgcatgagccaacacatttcctgctgcgtttatgtttcatcatggtttctgatgcttgcagtctgaaaggatctgatgaaaatactgggtgagaacacaaccagtgttcctttctgcaccttcatatctcagagatgtgcacggagtttctttaaaaagggcctttgcgattggaatgttgcagtgaggccaagatccctgtcatgctgcccttctttgccaaatgacaactaactgactcaaagtggagtaaacactgccaacagcttacattcaagagttcaggatgctactcccactggaagacctgtcctggaaagctgccctctgcctgactccccagagtattctggaaggtgcatttttctgaccaacagtcaggattaattactttttcatttgttgaaatatgggggtcagagttatatagacttaagagagagggaagaaaatagtgcatttttgcaactccagcctgaatgggcaatattgcacgttgcacgacttgatttgtttaattcaatgaagctcgacaatccacccaaatgtgtttaaccataggggtttggttaaataaattataatatatggattaaaaaagaagtaaggtagctctgaaatataccatcataaaaatatgtctcatgtatgaagtgttaagtgcactttgcacaatcacacctcaataaagtgaagttttttcaaaaatcaatttgcccaattatatgtataacatatgcccattaaaaaataatacaacagtcctataacttgcaaaagtttgtcatttatatgattaggtgggggaggtgggcaggaaaggaaggcgaaaacaatttgcaattaaagtaactcactctccttggatgattcagtccatgccagctttagttccctatcagagctatttccccttcacaagctatttcccaagacggaaagaagtataagcttgggaggctatgaactagaaacttgggcgtctaagaactagaagctgggatgtctttaggacttcagggaagagttcctccctggcctcacatctctcttgtaagaatgcctcatcctatgggttcagagtctcagttttcatcccagctgccattacctgtgcagcaggcagagcccagggctgattttaaccttgcaaagactgtagacgctccagaagaggagtgctgatcaggatccctgcagtctggctaggacttggggacattgtgaccctgtccagggtcctgactggcaagtgacacaccagaactcagtggctttctgtgtcccctgaggggctgggaaatcaaggcaaccccttcgcatcacacaggagacaagcgtgagactagagggtaccattcctggtcttctctctgcctgaacactctgtagtggcttgaatgctgacccctcagatgatatgtccacatccgaactcctagaacttgtggatgtgaattggccaaagggtctttgcagatacggggctgccctgatagctcagttggtaaagaatccatctacaatgcgggagatcccggttcaattcctgggtcggaaagatcccctggagatgggataggctacccactccagtatcctgttattcccttgtggctcagctagtaaagaatccgcctgcaatgcaggagacctgggttcgatccctggttgggaagatccttggagaaaggaaaggctgcccactccagtattctggtctggagaattccatggactgtacagtttatggggttgaaaagagtcggacacgactagtgactttcactttctttgcagatataattaaattaggtctcaagatgagatcatcctgaattatctggtggggggaggctctaaacccaatgacaagtggcctttcaagagaaagtccaaggaagatgtgacatagaagagatgagagatgactcagaggagaagaatatgtgaagacagaggcaaagactggagtgatggagccatacaaaatgccaccaactaccagacaccagaagaggcaagtaacaggctgccccctagggccggagcatagccctgccagtactgagatttcagacttctggcctccaaaactgtgaaagaataaatttttaaaccacttgttacggcaacccaagaaactcatgcacatttcctgctctcctttctactctactgtgggtatggaccaaatagccctccagacagcatcctacagagttctagaagtgggcagaagtcccctctggggtttctagcttttctacaaccgctcccaggctggggctcagagagaagggtgaggcacaggcagcctcttggcatcactctttcctcctacgaatctgtttttccagctctctaatggctcctctgagaaatggaagctctgcctacattattccgagctgggcaggcatttcaccctgcactgcaccataaattctttctacccgtgccttacagtaaaactccatgttcagtcctccaagtttgcgcctggcatctgcaggaagtcctgggagcagacaactctgctttctctcttatagtaggtgctgctgattctctacccaccttctctttccctgctccatctctttaaaatgacccagttttcattccggagtccatcttgcccttacatcacccacgtgcttcaggtgaggctaaccccaacctcagctctgggggctgctctaactggtggcatggaatctatcccacgtggtccagaaacccaagcctgagtgccagtgcagggcacctctccggccacagaaacaggcatgcaacaccagccatgatgccaagggaaatatactgggacctgctggaaacaggtatttccttgctgttagaaggatccaccagaagggacatgttctccttttcccttggtgtcctggtggtgaatgtctggcaattctgaggggagccaaccccaggatgaagccatcagacagagcatagccaaggggctgctgagttctaggccagagttgctggattaagccagtcctgaagcccaccctgtctctggaatctggttacctgagccaatacatctcattgttgaagccactgtgtcttagacttactgttacctgcatcccaaagcatcttgccaatataccacttgccacagccagttttttaagactactgtcctgttatgggttttgagatcctattttgggagtcaaaagctaactaagcattgttccttattcctcttacattattattgtagcaatttttaatcctccctaaggcagatggatgcctctggctcaataggaggaaaattcacataaggaagcttgagaaaaaatacacgttactgtatttcaaagaaatgatccacattaccctaacattcacacaaaaaacctgggggaagaacttctaaactgtgagcaggagcagctgaagaggacttgggggatatgtgtctccctttctaggctagtatcactgtaatgtttgaatttctagagtaagcatgtattacacttgtaatttaaaatcctgaggattagagtcatctgaggcatccagaattccccaggtaccgtccatggctcagctgtcaatcctgcagaaagtttatttgtggatcagagcaatgacttaagaagaatagtcacaatgtttctttacaatttagactttttgtttcaacagcgtacactgatctagctgagtgcatgttccccgccacaggaaacccttgccaaatctgtgccaagtggtagttaacaggactttggtgtctcctggggtcaggagaggggctgcagctctgagtcagccacagtctgcctcctcccttccaccccaggatctctggcacaaagcgcccatgcctctgtgaggtctgaagggcctccttgcaaactccaatcctgtgtttatgctcctcctgcaagaaggatgccacctcctccttggacagagatgaggaccttcagtatctccagaggggtctccagactctgggggccagagaccacagcccagaccccagtgccccgagagccccctgctctgccccagggtccccgtcactccctaggggttctcttctcggcttagtcctgatgcaatctccaagctcaactggcctgtctctgtcatttcccccaagctgataaagccagaaacctcagagtgagtggaaagagcctctgccctgaccagaagaaaccgcagggctgaccccataccccacagtaagagctggagaggctgggctctgggctcaacgcctggggagaggaggaagaaagatgaaagagctgaagaaaagaccatttgctatcacccgctcacacctgtccaccactctctcttccctggatctttccctgtgcttggtccctggactctgtccctctctaaagcttctggctccaggatcagaaaaagcctcagtgcgagcctcagttctagaatctcaactctcagaaaggctagtatagggggcctcagcactcccctgcccagacatgcctggggtaggtctgggattccttcatgctcacctcctccattaagggctgggcacccactagaaggcatcctgttccccatgggtatccagaaccctcaaatgtcccaaacctcctcatccaccctcacctctgcctggatgggcagtagataccccaggtctcttgccccagtcagacccctatgcaccaggccctgtgctgggcatcaggttcagagatgaggcaggtccctgctgcaggacagtggggggcaggggacagcaggtgggccaatggccagatgaaagcagtcacagtaactgccagctgctcggcccgatgccagctggggacgtgatattgaatggtcacgagccccttccccaacaagcagttcaagttcccagcagtggtctgtacagaagccctcgccagatgcagcatcgctcagagaggtcctcctggttcgcaggatttaacaagtaacccctgctccacggtcctatcgccctctagcattacgtgctcgatttgctcttccagtcacccactcccatcactggagtgtaagctcttggaggcagtatctgggtcattcttacaccccagaccctgggatgctgtctgggcactcacagtgtatttgtgggtactggatgtgcatgaaaggtggttgctggattcttgtccctccttctaccctatcagtcacctagccaaaccacccccaagacctgcagaagctgtctcttctgttctgtcatctctcctcctcgccctccccagactctaaacccagcctccccagcccttccttggtatttcttaatctctaactgctgctgctgctaagtcgcttcagtcatgcccaactctgtgcaaccccatagatagcagcccaccaggctaccccgtccctgggattctccaggcaagaacactggagtgggttgccatttccttctccaatgcgtgaaagtgaaaagtgaaaataaagtcgctcagttgtgtctgactcatagcgaccccatggactgcagcctaccaggctcctccgtccatgggattttccaggcaagagtaatggagtgggttgccatgctttctccgcctaatctgtaagcccagttcaaacgtcacctcctctgtgaagccagctcagatccctttgtgggcacattgcctgtcacatgatcctactgggcgctgcagccacgtgtttatgtgtctgcggcccccgcccccaccaccacctccactgctgaacagaagatcttcagaactgggctggggcccaggtctctgcgtccagggcttctacagagaccagggctgggcataatatcagagctcaggaacgatctgtcagatgaataaaggagtgagtggagaaatgaatggatgagcccccgttagtgagggatacgtgaaggagcaggcggatgcatgaatgagcaagggaagaagctaccgagtgaatgagtcagtgacttggggtgggggggagggggagtgagcctgtgaaggagagagagccgtgagggtttcagtccgctccagcagccctggcagcagccagcccccgccacccctgggcctgagctccgtgccaaccagacctcccgatgcctcctcccagagccagctgccgtcagcaccgctcagcacgcgctcccgatgctggccagcccctgcgctgggccatgaatcagacagggcactgccccagggctcccaggacccggggcagacagacagcctcataaataaacccgatgccctgctgggcagacatgtgttccagcagtgcagtgagctcagggttggctctggagccggggctggcagggcagagcctgatggagaagcctgggagagcctcaggaagagggacctcagggctgggcctggaggagaaagggcacccggggcaggagggctggcagcagccaaggcacagtggcttcgacagacacaggagtgcagggggagggcgtggtggaggtgggaacatggggaacgcagggcctgagtggtggggtcaagaagttgggattggcagagccagggctggggacacagcaggatgtaagcagagtggggcacaaggactgcgggctggcggtgctgtatctcagaaggaaagatgggaggctatggggaacaggtctgtgagtttctagggcgctcagggctgtgtcctgctatagctgttgcataattgagcttctggcttctctccacaaagtcaccatcatcctcccagccctaatactcaccaccagcagcttgaggctttggagcacccaaattagggaggttactttggtgagaacacttccaagtgggtgtttttaagccaagattgttttataatggttcagatcatggggaagatcctggggtttctgaagcaaatcagggaatttcagaatttgacaggaaacctcccagttgaatgggtggaggccaccaattcaaagatgctgagcatcctacagtgcacaggacagcccttcacgacaaagaatgacctagtctaagagatcaatcgtgccatggtgttcaactctttgcaaccccatggactgtaaccctccaggctcctctgtccatgggattctccaaggaagacgactggagcgggttgccattcccttctccagaggatcttcccaactcagggatcaaaccgggtctcctgcatcacaggcagattttttacctctgagccattgggaaagcccagtgtcgaggttaagcaacctgctttcacaggtgggaggactaagacggtgaggatgctagaccaaaaggtggtctccagtaattcacgtgggtcttcatacgtgccaggagctgttctgagaacctacccccattcactcatgtcatctcttcctgctttgaggatgaagattaaagacatatgtgattttcccagggtcacacagctggtgggtggtgaaggcaggattcccacccggattgtctggcttcaaatgctgtgctcttgatcatgacatcccatggtctcccacatcacccagcagctgggacagagctgggcttgggcccagagcccccctctccaggcagatgttccttccactctgctctgggccccaggtccatgtaggagtcttgggctcctccaccaccacagacgtggagcttagcaaccgggactttgatttgtgagggatgcagtgggtgggcaggaggcagatcccagggacagagggcctttgtctgcctgcagatgggcaggggccagttgggtgcaaactcattagacagctgccgaggctgccaaggagacgggagcaattagcgggcttggctgaagccaggaagtggaagccgctctgtgagagctgctgagcctccctgccctccaccaggacccagctccctaggaggcagctgccaagtttatgttcagtttgataatggcagctccaaccatccttacaggttgaacctactatgtgctgggctaggcacattccatatcttgtcttttttcatctataatcacccccacccaccttgggaggctggaatgactaactccattgcatccacttagtcatccttccattcattcgacaggtattcatttattgggtgcctactatgtgccagctctgtgctaggtcccagagatgcagcagccaacacagcagacaaaagtctccactccagtggaccttctgttctggaaggggaagacaggcaacaacaaaaaagaaacaaacaaggtaactgcaacttgtgatcagggctatggaggaagtgaaggggctgatgggaggatgctggggataaaggaatcagggaagctctctctaaggaggtgacagttcacaggggagggacttgggctccgagaggaaaggtgacttttccaaggtcacacagctggaaggtggaggagctagggcttgcctccagccttgacctgggcacctgcctcacaggagcccctgcccctccaccaggccaccatccacagctgtgccacacactggcaccgtatctccaccccttcctcatggcagcctcatgaaattcgtggggttatcacctccatcttacaggtggagaagaggcccagagggggccttcacaaacccagggccctgcaaaggaatgacagacaaggggcttgagcgtcttttgatccccaaacctgtattccttctgccacacctccatccttcctggccaagcacttgacgcgcactgagcgtttagtaggccgataagaaacagatggatgcatggactatggggccttgggcatcatctcctttcagtgcttccatttctccattagagaaggcgagagggtccagaccagcttcaaaatgcccaagttcattctactctgttgacattccttgaggagcgtggtcccctatggagaaaaagatgaaagggactctgcctcccgcagactattctgggcggagcaaactgcaggcagaagcatggaggtgggaaaggaaatggcgaggagtcagcagacatgtttaggacgcggagagccacctggaactcatatctaagtgtccctttccttttcctgcattcttaccacctgtcacctgcatagggtcttaggccaccagagcttcatctcctctcaattccagctcttgcttgagtcccagagagtctcccagaggaggggctgaagcagatcccaaatatatctgtgccaccaactgtgcacagtgtgatcttggtcaggcagctggtcccctccctcagccttggtcttcctatcgattaactggggagacagtgatcagagcaagtcggtagcacaataaaaggtgaggtttatgagcacattctccatgtcaggcagtcatcccttgagacaggcaattttgttatccctgatgtacagataagagatctgaggcttagggaggtgaagtcactggcccagggccacacactaggaaatggctcccccgggggattcacgcccaggtccatctgatgccagagctctgctcataacaaaaagctcatatgaagcaatgccctgccctttgacccacgcaacactcaacccccaggactttactcgtaggaaataatccaagagagccaaaaacctgttcacagcgggcctatttacagtatggcagatcactggaagaaatctgcatgcccaacgacagggctctgttcactttagaaattaggcagcttcagatggactgtggcttactgagcaccagctcttgccagttgctccactgtaacccccaccctaaccctgcaaagtggatgttgctttctgcatcctgggtgaggcctccaagttcagagtgtgaaggattggctgagggctcacagccagtgttgggccagggcatgagtggtgtggccaggcctgttcacagccacaccccaggtagctctgttctacaagaaaggaagctaaggcaagtaagtgacccagtaccacacggctgataagcagagaactggagtttgaccacaggaactgggactgcatactctgggaccacttccccacactgccacctactgactgggaaactgcaggcgagtcatttaccattcccaagcctcctgggctcctcatctgtaaaatgagaataagattgtctgttgcgcatggtgtcaccatgtaagcagtggtaaagatagcaatggcaacactggtaatactgctattcacagtcgataccaccgggacagcgttctgccgtgaaaggaaaccttgcctgaacgttagaaggactggctgcaaacctcagctaggacacgtctcaactctctctgggcctcagtttctccatctgtaaaatgggggagggcacacttgagcatgtctccggctctggtggtctctgagcccaggaacactgctatctcgggttttccctgggactctgcctgctgacccctcatcacacactggtctgggggagcgggggcgggacgcagtgggtctgggcttgaggacacatgtactggaggaggacaaggggcccttggacagggaaatggaggttaagtcaggaagccccaacactcagcccctcaacacacagcccctgctcctggcctaagggccactcaggcagcatctgctctaggtcctttgtacctctgcatgggacctgcctctgccccacggcctcagtctctcccctccctgccagcccctcaaggagatgctgaaccttggtgaagagaaagcagaggaaggcaaggaaggaaaggctgaggggaccaggagaagaggagaaagcaccctgagaaggaggggtgaagagcatggttttacataatggatggtaggggtgggatgagaacgaggcttgggacggggtagggaggaagaagaagaggtcaacagaggggctgagagggtctctgacatttttcagagttccctttaccaaccctggtgaccttcgggtgccctctctttatgtcctgctgactggatacactgggagccaggcctttcacagaggtcatgccagccctgagggcaggcctcccacatggctccagccccataggcggccacacagaagggccaagggatgtttgcgggacaaaggacttggttcactctcccaaaggctctgaactgagaagaatgtagacatcatccaatccacctttcctcacctgccgccccaccccacccccaccaagggaggaaggactttctcagggctccaaggtggggatgtcgatgtcagggccagaaccggaacccagtgtcctgtgtcttgggcctttctccagcccagccctggagggtcccagcagcaggaagaatccctgcctctggttctggcttaataaccagccacgaggcggggctcagggcctgcggctcagctgccagtctccccaggttgcaagagcattaaatggcctcagtgatgcacagctttgactcctgagcaggcgaggctggtggcagagaatacactgatgtgacatctgggggctcctgggagcctgagccccggacaaacctccaccagcgtctgaggaacctcaggctctgcagagtcagtggcacagaggcccgcagcatccttggaattgaggcctggtgtggcagaaagaggagaggccagatgacccaccgagataccccagaggcagcaaagctgagagacacagccagctgcaggttaagagctttcaaaaactttcagctacagccaaagacaggagatcagtttgtaaacagacaacaaaatcccacaacaccctcagatatgtcctaactcatctctctgatgggctcagagctggagctggcctgctcagattcctcatccctttccaagaaaggggcagcctagccttggacttggagaggccaatgccttcctcaggccagttcttctattccctccccatccaaatgcatcaacaaatcccctctgggtttattttcttccctccttccctgcaggactccagcctcatcccatcagtggtgctcacccttcctcccaaaccctccctggctccccatgtcaacaaggtggcattcagactacttgacttgacattcaagtgtgatctgctctctgacctcaaaccctactgctcccctctgccccaaccatgactctcagtcttgggatgttcttgccacaggaactgcacattccaatctggtagtgggcatgcttttcctctgaatgcaggtgacccatgcgtctgccccaatcagtggggccatggtagaggggactctcaaccctaccacttcctggaagtgtgaccttggggaagggagtctcacttttctcatctgcaaaatgggaatgctgatcccttcacgggattcaaaggtctgggcacagtgcagatcacagaactattattagctattatttagctattattggattccctgatagctcagttgataaagaatccacctgcaatgcaggagaccccagtacaattcctggatcaggaagatctgctggagaagggataagctacccactccagtattcttgggcttcccttatgactcagctggtaaagaatcctcctgcaacgcgggagacctgggtttgatccctagttgggaagatcccctggaaaaggctacccactccagtattctggcctggagaattccacggactgtatagtccatgggtcgcaaagagtcagacatgactgagcgactttcactttcactttagctattatttatcaggatcagtgctgttattacttcgtgcggtcccacacagcaaacatcctaagcaccgggccactggcaggccccaagtctgtcaaactaacctcacatgataatattagaaacactcgcctccatctcaacttgcatatgtgaaactgaggcccaggggcccaaagcccagctaacagcagaacagaccagaagccacatctcctgatttccaagccagaactctttccctacaagctgccactactaaaagccgagttcagacgccaaactttaattgtgatagtctcagtttatacaagaagaaaaacctttgctccatataagaatctttattatttattctcacttttaatgccccaccttgaacattcctatgtaccttcagagaacacccccctcctcctcctcctaggcaaagctcactcctccagctgctctttctccccacctcttttctctctccatccctggggaagcctttatctgaccttccctggcggagccaaagggcaaatgctggcttgcctttttgctgctcagctaaaaagctgactgccttttctcactttctggattgtgttgttgttcttagcctcaagggtctaccctgtaagagaaaaccagaacctccctctccaaagcctttatctattcccagttcctcccatcttaaaaaacaaccagggaccagacaaagcaaaccttcttctaccctcttctccttcagtctggcccggtttcttggtggtgacctgttatctccaggctccatctccttggcttcatctcctactcgccaacccatggggttgcctctgctgtgtcttctgttcaggtctgcagcgactccatttcccccaggtgtgctgggctctgggtagccttcaatctgcctgatctgtctgcctcagtttcctctctgagcgctgtctcctgggggttgtctgacactgtctccccacagccctgccagtaacttctcaatgccctttgttgggctcctcctccatccaagccttgacattctgtcttgggtcctcttgtcttcccatgctccttcccttggcctccttataggctgaatttccatctctagccaatgattgctagagtccacctccagcccaaacttttctcctgaggcccaggcctgggcaccctgttgcctctactggatgtctcttgtctttttaatgattatttatttgtttatttggctgcactgggtcctagttgaggcatgtgagcgcttagttgcagcatgtgggatctagttccctgaccagggatcgaacccggattgattgattgatccaggggtcaagacagggatcaaactctccattgggagtgcagagtcttagtccctactgggtgtctctaaggtagcatcaaccgagcacatctcaaatcatctcatcattttcttttgtgaaacccatctcccctcccgagcccccagctctacattcagccccaccacccaccctatctttgaagttgaacacctagaagtccctgatgtgtcctctttctcacccccacacccagtctgtcaccacaccctgctcagtccatcttccagaagcctgtacaacctgtccaggcgtcctgagtccaccacctcgacctcaatccaaacactccacttctcccctagtggagagtcctaacgggtctctcaaagccacacataccctgtactgcattctcacagcagccagaggggtctttctagaacacagatctttccatgtcatttccctacttaaaactcattactgtctgccaaatgttctccagtgaaacctccagatgtttggcgtctggtcgcaccctccccacccaccccccaaacccggccagctctctgagcacaaaccactctgtcttttcagctttttctttcaatttgctgtatttcttcctgcctctgaggctttgctgttgctgttttctctgtccagaatgcttctccttcagcatccccaccaacccatccttaagagatgaggccaagggttgcttcccaccttccccccagggcctctaggatttcgacagctgccaggctgtttgcgctcacccctgggagcttgtggttgcttgattcatgtctgtctgggctcctggactgcaaatcatgaaggccaggggccatgtctgtcttgctcatcctaaaaccacactgtgccaggcccacagcatcccacagccccacctgcccaagctacccccagtccacaaagccagcattaactgccccagagaccaactccaggctggaattcaaggcctcacccttccaaaactccccatccttaacccctcacacacaccttccccatccacactggggagcctcctctctcctccctttgctcccccccatttttccttcatccttctttctctaatgatattcaagctcaccattctccaatgatgcttctgttccctgaccacacagcccatcttattttggattgacaggcatcctccctagcttcaggatgaaattacaaggcacttgaggttctccataatctggctccggcctacactctcagatctccaccacccacacaagagtaatctggcacaagaggacttagccgttaaaggattcttggcctttctggattcaagccctgcttgcacttcttacaaacttcaggatcttgagcgagtactttgctaaacccctatttcctcacatgtaagacaggaacagttaagagtctccacctcattgaattctgtagagattaaataaggaaatccacaagaagtatttagcccagcacttggcaccaagaagctccaagctcctttcctctatcatggccctaattggttaagaacctgtccttcccatgggtcctatgttcagaggggatcctgggtgcctttcatctctgtttcccctttgcctagctcagtgcctggtcccaagaaaactcaataaatgcttattaatgcatagatagaccacacacttggcacaagtcatctcattgttcttcactttcatgtgtgtaaatcttatctctcctaacagagtttgagcttcagggtatgggggaggtggtgctgggagaaggtggtgaggtgtcttcatgtcagagcatccagaatgggagggatctctaagctcttgacatccctgtaccccccatggtgcccagcctggagcagggagtcatgaaggccttgttgacagatgggcctgtcatattccccaagaagaaggcacgtctcccgctccgagatatcgccctaattactccctggtccctcccctccacacacacatcggctttcttaggcaagagcctgcttgacttacacacatggagttcttttagctggtggttctgagccagctcagccagtttcttcagaaactacagcagaaagagaggaaaggttttttaaagccatagggcacaaaaccagagtgagggatgggtgaagtttccccagcaaaaggccagcaatggaccagcattggtcagatcatctcagcactgttccaaaggcaaacctgatggcatagtagaagggttaagtgtgtcgggctctgcactcagagactctcaggtttattccaggctttggccctaaccttctgggtgacgctgcacaattgacttaccctttctaagctcagttcccttggctatagagtggggacaatgttagtactaggaggatttaattagacaagatatcaaagggttggctatcactatgattatgatgatttttgtcattattattataataccattgaatataagatccagaaggaacctcaaaggtcatgtgagaggagagaacactgcagccagcagaggtggcctgactttgctaaaacatacagcagatcagtgcttttttctttacctctttcgctgacatctttcagagaaccaagggagtttgctcacttacccctgaccttggagttggtcccctaccttgacttgaagaacacagatttgggggtcttgaagccaacaacgaccaaaaaaatgggcattgttttcaccaatgggccctcgccagttggaggtggcccagccactgctgacaccatgctataggatggagcatggcctctacttgctatccatccttgaggaagggactgtgggctgggttcactataggcacagcctggacttgggaggcaaggcactgtctgctcccccttctccagctgagttctgcactctggcctctccttagcccggcccaggggctctgcctgcccacctgcctgccaaatggaatccctgcttccacccatcccaaatgcctcttccccactgccctccctctccctgaggctgggaaagacctggctggtccatctagaggatggcactgggcagggggcaaggcttagggagctgtggaaggccgctgccccgggtcaagaaggcaggtctccagcaatcttcaagggaggtgtgctctcagggctgaaggggagcccaacagcactgggagaaaaacaaaaacaggaaggcttgccatccagtaggcagctactctctccttggctcaaattacatgtcattccagtcaatcttggcaatagctccttctccactgggtggtttgtgagggcggagtgggaagctacatccacagcagagtacctggaaagaagaagcttgtgttaggggtgcacggtgagagaggctgccagctacttctctgtcgaagtactaacagaggtgccccttagaatagaccttccttgttcaggtacatctccctcggccagggtggaggaagcacgctcctctcaactccccaaacacaaagccaggaggtccccgtggcctgacaaaggcttctactactccattggctacagagctggcctcagaagcatcagtgggcaaatatgcatggggcccaaaaagcttccatgatcagggcctgcgtggggcacgcatgctcaggcactttagtcatgtctgactctttgcaaccctatggactgcagcccgccaggctcctctgtccatgggatcctccaggcaagattactggagtgtgttgccatgcccttctccaggggatcttccttaaccaggggtcaaacccacgtctcctgctttgcaggcagattctttaccaacgagccatcagggaaacccttctatgatcagcactgtgtcttaaaagttgggataacccattgtctagaaaagactccaaatagctggtcccctctccatgagggaagggagggtctgaaaggaggaccagattcagcacaatgtctgggattttggtaggagagctggttctggcttcccaagtggctgaagtagaagcctctcttggcctggcatggtggtttgctttgaggccaatggctaagaaagtgctaaccttggacccaaagtgcagagatcgcaggagcacaggctccactgaaaaggagaacaagggtccgtgaagctgagcagagcacgtcttccacagcgcccccattgtcagcagcagcagttagcactgatggcctggtgaggactagtttctctcttcctgacactggaagtaggagtcttctcttgggacagagaaaccttctgggtctttctggacaagggacggcaatggcttcagtcaggagacactgaacttccattaaattccacaggcagatatttgagcaattaactggaaaatgaagacttgagaccagtcctcccaaactagtgaggtgcatggttctggttattgcatagaacttgactatctcgttggttcctcataacagctcaacaagcaggcataattatacccactaaatatatgagaaaattgaggttccaaggagtcaaagacacgtgccagttcactcagctgggaagtgttggacctgggactggaatgatctctgctcagtgccccacgagattgaacagaaacctgaggacccagggccagcgcttctcatactgactctttcctatccttcagattacagtttaaccatctcctcctcaaagaggccgctgagccccagaacctgcagtgtgttccccccaccccatgacatctatacatctggacaatatttcttcctttcttagaatattatcataatgatcataacctcatttttacttgtggttttaaaatctctttgatctgcttctctctggagaatgttttccccacgagacagcacataatgtgcagtgtgcaccactgagccccaggcccagcacagggccgagcacatggtggaaccctgtatattgtttgaaggaatcattgagtagatggttaacgggtacttgaaagcatgtcctctttggatggcatgaaaaatcaagatgatcataagagagaggagaaaatccaggagagacacaagaccccatctccaaattctaaagggctgtcctgtaactataggaacaggtggggtgggaggcacaaaactggggttgctggaaagcaggactctcaatggttagggaaactgagcccctttcgaggctcctgccctgtataagcacaccctgaccatctatcccttcctgccccacctgggaaggactccagccatagctaaaggaggcttgtcaggcctgagtggtggctgctcagggactcaaagcaaagcaggttgttggggcgggctccaaggaggaggtgagctgcagggcttcctgggggattatcaggagcaaggatctctgggcagagacatgggtctgtctgctgaaacttgctcagagcagcttctgggcttcctggtcagataattgcaaacaaaatagaccagggactgggcagcagctacaaacccctcttatataagagaagggcctgggctgaggcatgcaggagcaggcagcagggccctgagtcatacaaggaacgagacccattcagaacagctaagattctggcctcagaagctttcagtgatgatgctggtggctttgcctttctctggccgcaggcttcccatttgcaaactgagaaccactggacatccactctgtacctggccagcactggggagaaggaggcattgacactacctcccagacacccaggaaggagcaccaactgacacactctggttcagacccggggtcagggaaaggcagtggggtagggggatcagcagagtacttccagaaagaaggtggaggacccatgctttaagctctttctctgtccctcttaaggaaactctgaccacccagaagagactggaaggtggccaagaaggatctagccgcaactggccagcagtacctgggactcaggtgcctgggtttcctcggggaagtgcacatttatgctcatttgtattatgctgcaatgtacatatatatatatgcaaatcacatatttgtgtgtttgtgtatgtgaatctctatactcctctgtgtgtgtttgcttctaactaggtttaattccaactctatgtgcccatgcatatgtgtgtgcccttgtatgtttctaggtatacacaggagtccaagtgattacgtaagttatacacatttattcattccagatatttatagggtgcccattacatgctacgtgttgtcctagggctgagaatgcagaggaaaaaattcaaggtctctttcctcatgtagtttgcctgcagcataaaagataagcaataaatgagggaataaacaaatgaataaataattgcagattgtgatcacttacatgaaagggaaaaaagcaggataattagagagtgacttgactttacataaagaggttaggaaagacagcttggaaatacagaaactcaggcctcaaacaagacctcctaattcagaatctgcattttaacaaggtccttagagggtctgcatgcacatcagacattaagaaactctcattaacatacacatgacatggaggacaaagggaatagaggcaaatgccacagatctccttctgctgctcgccatgagataatagttgggattcattgatcagtttccttcttccctgggcagaattctttgcccacaaaaatcactcaaggatctgaaaccttggaggccccgcccaactaaggctaccgcagtcttcagctgttgctgttcagtcatgtccaaccctttgtgaccccatggacttcagtaagccaggcttactgtctttcactggcgttccctgtctttctctacctcctggagtttgctcaaactcatgtccattgaatcagtgatgcagtcttcagttaacttttagcctaagacattttccacctctgttactcactgcccccactgagaatcagaaagctgatttccccatgacagaatcagtaaccccagtcacactgaaacccccttttctactagcttgcccaaagacataaggagttttcaatggtcagctggcgttcttaacttccacttgaatgcaaatattcttgcatcctctagtggaaacattccttccttgggcaccaaaacttctgaccccaagtttgaggggcaggtccttaggtgggattgtaggcactgccactgctccttctgctgctcagcccctggccctgtattccagctctgggagaaatagtaccatgtatagccagctgattaagagtgaatacagcatcttataggatgccccttccccaccaccaacatcacagtgtcttttaattccctttggctctgggacctagatttttattaggtcatttcataattttataggtccattgatttcttggtaatggggtacccgggatgaccaatggatccaattatcttcagtccattggcttactcctctccctgtaaaatggatttcttgatctacagcaatgttgtatgggatatcaagacagtggatgaggtattcatagagtctgcagatggttctgctggaagaattatggcaggcaggggaagcagatccaaatccagagtaagtagctgttccaatgaagaaaaattgctgttcctcccatgaaggaaagaatctgatgtcgtctccccctgaccacgtgacagccacagctgctttgtcactgagtccactgagcaagccctggggtgaccaggaaaagacaccaacaggcatccacaggaggtcatcttgaccacctgtttcttaaagccctttcttccagggtcttcaggtttcattcgagtgagtgttcttataggacacaagtaaactcgtgatgttggatccattctgagggtccaatcacatgccttttctccaagcttctctttcaccaacccttcagtcctgtctcttcccagtccctgtccctctgaccaaatcattagccacttcccatacatcactgtagaacataaacctctgttcttccagaccgagacagtgagacacaccaaagtgctgctcactgcggggatttctctattctgtcctccagggatacctctaaatggggctgtaattacacagcctcacactctactagcataacacgcagagccatttgttaagcaggctcagaatgcttttctcctccatacatgggctatagggaattcctgtgagagcgtaagtgtctgctgagaaagatgcagtatccagcaggtgtgagccacctcttatgcaacatgcttgtgctttcaggacctgcttgggtccagaccactttaccacctccactgaaggagggagtactgttgggtgtgctcagtttaatgggtaggtggacctgataacacagttgttctcttggactaaacgattgcatcatagtctatgctcaggtggttagcctctgttagtgccaaggggcaagccaagagtcatttctcaagaggtgaacatttgccagagaaggcatggtcttgctccaaaaatgaagcatctccagccatgatgctgctctctggtcttgccaaaagactccatgcagcatctcaatctgccacaaactttcagtacctttgaatctagtatattataaaaacttggcttgaagtcttaactagctcagatcccatttaaagccaacagcttttttgctcactcaggagctggcttgaagtagaagacacaagtgtggtagatgttgcctctaaaacccaaagcagcccaccgagtgataagtccctttcttagtgatctgcgatgtagagtgtcacagcctattcttcactttgaaggggatattctgaatttcccaggctgatattttcccagaagcttaattgagttccctgtattttctcagactatttttccttcaccatgcctctccaaatacaattgtatttcaagatacttattatcttatgatctctgtgtcctacgagtaagatatcaccaggacgtctctggcagtccagtggttaagactctgcttccactgcagggggtatgggttccatccctggttagggaactaaaatcccacatgatgcactgggcagccaaaaaatcaccagtgttctagatgaatgatgaaaagatcgatgtccctatgaactaactcgttagagggccagacgtgaaattagagttgacacagcatcatggcgaagtgggaggtgcactgctgttctgcctcgagaagtctacacacttttgatgtcctctgattattaccatagaggagtgaaagtattctctgagtgttaggtttgcattaatttgttatagccacaaaaccatacttgaagcatcatgggactataattggagttaccaatatatattaatgataacaatcccacgttaatttttaagacttatctatcttacgcattggtcaaactagaaaattttgaccttagccttaagctttgtggtcccaccaaagaagtgtcattgcactgacttactactttgatgttgtttgaaaacctacagtggctttcacttaggctccatgggtcagggagccagtgtagtaaatctgccaattctggggttgtctattctaactatacacttggaatctgggtaaataaccacagatagtactgctgtgtggtatggaagaggctcagatcaacattccaaattaaaaagtttatcttatccaaataaatccctaatctaatcaggtcagtctctggggtaactgatttctttagaaatactggagtgggttacccttttgttctccaggggatcttcccaacccagggatcgaacccgggtctcctgcattggaggcagaagctttaacctctgagccaccagggaagccccttcattcagggctagtatctactaattctcaaaatatctagggtctttgcctgtactctgttaccttgaaacatgaccacatatccctttggggaaggacaagagaagttttaaggaattaaattattacccaatgtgttattacatagtgtttcttcaagggggtcccctcctcttttatacaacagactgtttctgcttattgactaggggaggttctgaaaattttccattgtgatagttcagcttattttctactcataagatgcatgtctattttattatatgaatcaatatagggcttttgtgggctctccacctcttctggccttaaacccatgatcattaaccatgtccaaaaaataaagagtgccctgttgtttgaaccattccaattaccacgaggctctgctcactatgacggtcacacacccagcctctaacctcgaagtgccaccacatggtctctgccacactacgatcctcccatttccattgacaccagggacccattcagctatggcaggctctgccaggatgcctagctcacagagcacagccattgaaggggtttttcaagggggttggcttttccttcatcagtgttttcccccaaggtcttgctgaagggactcctaggctttcttaggagtcaaagtttagagtaggaggactcttctttcttctgaatttttacatcaagaaattctttcagctcctaaaaccagaacattgaatccagagctcagcaacatcaggaaattcatccagatctagaattcatccccacatatattcccgagaaattggccaagataaattagcaaagtcttacaattctgtcagcgagtaaactctctccactaaggtttgcctttgtaatttgtccccaggaacatactggaatctgatctagtcataagcctgggggactgtgaggaatgttggtttccctttgtaagataacacccttaggcaaggagtctttaactaaggccagtcttgtctactagggtagcagggccaatttggcaaacatggaggacttcctggggtttgggagtctggattgttgcgtctgtcattctcgggcttagctccatttggattctcaattctcaccttttttggattaattttttcaattttatggaagaaccctgcaaaggttgaggattcaaccattagacttcagcaactaccagaacaaacctttccaggtgtgtgtattctcagtcactttagtcacgtccgactctttgcaaccctatggaccgtagcccgccagactcctttgtccatgggcttctccaagcaagaatactagagtgggttcccacgccctcctccaggggatcttcccgacccagagattgaacccacatctcctgtgtctcctgcactgcaggtggattctttacctgatgagccactagggaagctcctggtgtctcaggaggtaaagaatctggctgtaacgcaggagacccaggttgtaggttgggaagatcccctggagaagggaatggctacccactccagaactattgcctggagaattccatggacagtggagcctggtgggctacaattcttggggtcacaaagagtcgaacatgactgagcaactaacacttttcactttcaccagaacagaccggccctgcctcaataaaagatgagactctttcccagtcatagcaagttcctgaatttcagtccacgccttcaatcaaggctctagggacttttgttcattattttctttccttaagctatccagtgccattaaaagcaaacattccaccccacagtcctcagagtcctcctgccctttattcttctctgtggcacaggtcgtccaagcccctgatggcttgccttccatgggtacttcattttaggtgaccacaagggacactttaattagctgtttcagcactggggaccatgggcttctgggtctcctccctttgtgctagctgttatctcccagccttcagccctaactagggcaggagccaatcccagattcccaggattccctcggggtctgtgcctgcaccccaattacggcaccaagatttgtactaatcagggtacttgtttgcaaacaacagagagaaattctgtttgacatacactgaaaatacacaggcatcaggatgttcatcgaacctgtgcagaagccagaagaccaggcaggatccagagagacacagacgaggtcttgccacaggaatgatacctcaggagctgctccgggggtgtcgccaccaacctcctgtcccaccacaatgatcctcagtgaccctgcaccttaggccactctttctgttgagcagtcgagtgtgagtgtgtgtgtgtgtgtgtgtgtgtgtgtgtaggtgcatgcatgtaggtaggaagagaggaggaccagcgagtagctagctctcttatgggatttgtagggcaattagcactaaattagacgtgacctatgccaggctgaaatcccatctctaccatcaacttgacccagttgtgttatcttgagcaaatctctgaccatctctagacgggcctcagtttcatcatctgggaaatgggaacaatatccattcttccagcctcactgacgtgttgtgctcccacaccctccttttctcatggataggacttagttcaatgtataacgagacatttatttgtgaaggtaccactaatgttcctccagtagacggtaggctctgtgaggtcaaggacttcatctatctgcttagtgctgttaccccaacacctagaaaattgcatgaaatgtagcatgggcccaagaaatatttgaatgaaagactaaacaaggtaaaggatcaggaaggggatttgtaaatcgtcaagggccgcacatgtgtaagtgctggtgctttggagccagagagaccttgaaagtgaaagtgaaagtcactcaatcatgtttgactctttgtgaccccgtggactgtagttcatggaattctccaggccagaatactggagtgggtagcctttcctttctccaggagatcttcccaacccagggatagaacccaggtctcctgcattgcaggcggattctttaccagctgaaccacaagggaagcccaagaatactggagtgggtagcctatcccttctccagtggatcttcccaacccaggaatcaaaccggggtcttgtgcactgcaagtggattctttaccaactgagctatcagggaagccctgctgctgctgctaagtcactttagtcgtgtccgactctgtgtgaccccatagatggcagcccaccaggctccccggtccctgggattctccaggcaagaacactggagtggggtgccatttccttctccaatgcgtgaaagtgaaaagtgaaagggaagtcgctcagtcgtgtccgactcttctcgaccccatggactacagcccaccaggctcctccgtccatggaattttccaggtggagtggggtgtcattgccttctccaatgcatgaaagtgaaaagtgaaagggaagtcgctcagtcatatctgactcttcgcaaccccacggactgcagcctaccagactcctccgtccatgggattttccaggaagccctagagagaccttaattatcactattattgttgttgttataacccttgaattatatatattcagacacacagaattatttttagtgcaataaatgtaccattctctctctgtccctgcctgagatgctctttccctttctctccccctactcttgtgtcttcttttcctctacacttaggggaagtcacccagtgtccccatgagttcccgccatcacctgcacaccagcctcagcaggggccccctgcccaagactgtctgggagtcatctgccccaccccctccctccagctactccaggacttactccagaactgcagttacacctccttgtctggaacctcgggacctgacccaagacccagcctacaatggaggtttaggaaacaaatggataaatgaatgactctctgttttcaaaattataaaaccaatctctgtctttgcttgaggacagagtctgaagaaatgacctaaacccacagaaagatgcactaaaattagaccctaacagaaacttccccagtcgtgttatttactaagccctacaggggagagacagagacgagggaggctttccttcctcctggggaaaagcgaggggctagggagaggaagtgagacccttgggaaagtatacctccattggcagggagctcattacttgttgaaacaggctcctccattaccaacttccttcagcaaccagagtccactcagtcctcatgtttctgatccctacccttcacctctcccaccatcccctctctaaagagagtgtgactttgcagagctggcagccagcaagcctgccaccattcccaaaagaagacagaccttcctaacagtagtggagcaggctaactcagaaggtaatcaactcctcgatggtggaaatggacacagacctgccaagagatctgtctttgtaacacaacctcacttatgggagcactttaagcttaaccttctctcttggccatttgcgctgggttttgaagccatttttccaggtaaaagctgaaggaagggcattcaagacagaaggaatggcacgtatggaagcatagagatggaaaacggccccatgtttgcaaaaagacaaatcatcttgactttcaaggccggaatgtggggccccaatatttactgagcacagactctgcacagatgcaggggtaggacctggagagatactgcaaataagacaaacacacagtctccactctcatggaatttataatctagtgggggaacagaaaagaaacagacaaataagtgtgggcagtcttttcagatggttccacatgctgttaaaaaaaaaaacaggtgacacagtggagaacgactggtggttggggagcacctctctgagcaagtgacatgtgagctgagatctgaaagcagcaaagagatagtcacgcaaagagcaggctgaagaagttcctagctagaggccagcaagtgcaaaggccctgaggcagagacaaacttggaattacagagaaacacaggaggccagtgtggctgaagagtagggggagagtacctggtgctctgctggtctcccctgccccaatctctctcttctgcttggacactgggtctccaagcccagctgagtgttcagagcaagacactcactccctgctccccagtccccactgcttcaggatcctggttcattctggcagcaaatctctgcccatctcagtcagctctgcaaactcagcctgctgcatcctgcataagcagcccagcatctcagcccctcctcccccagccaagaccccagcacccactccaacctcaacccagaagccagggttcaagcctggtccaaaggggctccagtcaccaagctggatagccctttagacccaaaccaactgaggagccagctctggaggacagtgtgtggggcgggggggtgtcaggagcggcacattgttcggagatggcagagccagacacgagatcccagactagatagagctgggaacgaggaggggggctgggcttggcgttcctgggtggtgatgccatctccccggcaatggagggcggcaggcaggagcctcccattcccccagaggacttgtcctccctgctatctgatgagggagctgtcggttacaggaaggcaagactgttcacaggacagctccagggagcaggaaattaacccaccagccagagacagggggaggggggctgggcggggcaggtaattaaggggccctgcaattactgtgccttcaatctgggccagagttctcaggaaggggatggagatgctgctcagtcggaggccccagctgactctggcagggggcatcagccctgtctcacactcttccttccgtttccattcctgtctcccctgggccccatccctacctctgtccaaccacaagtgatccgctcattctcatctttgcacaactgttcctcccaccctaaaggcctttcccactcactcgatcctgcccttccatcggctcatgcaaaggactgttctccaagaagtcttcctggagcagtcatgtcggaagggattgctctgagctcacataacacagcccttttgtgttacgataagggaacagactcagagagggcaacgatcggtccagggtcacccagcagaatcaggactagaacctgagactcctgcatttgggactggattttttaccaccaccctgtgagctcactaaccgataaccagcccaggcgtcatcacatgccaaccacggacacagactgaggaccacagaagggtcaaggggcccgtcgcatttatccagcatctacttgctctggattgcggctggggattgggaatgctgtgaccagcagacacagacacagccctgcctttagggagtttaaggacccgccacaggatcacccagaggtatgttccaagataaactaagaagaaccttcaaaaaagaggccccaggctggtgaaaccttgtgacaaagacatttaacccaacctggggcccgagacaggcctctctggagatgctgggcctgggctgcaatctggagagtggaagacagcaactagatgaaatggagcagggaagaacgttccagacagggtgtctggcatgggcacagtccagcagaggaagtccagaatggctggagctctgagtgaagaggtagcctgagatccagcagggaggccatagggccccagcgatacaggactctggcttgggcatttgatctttatcctaaaagcactgcaaagccactgtagagttttcagcaagggaactgtgtacatagggaataccactggctgcagtatgaggaaagggttggaaggaaccagtgaaagcggggcctgccgagaggctcctccatagtccaggtgatggtggcggagaccagcactgtgccagcgggcagtcaaggaaggagtgttgagaagggatgtgttgaggatggaatctcccggggcagggctaggacaggggtgggggacaagctggggacggagtggagggagaggaaggagtcaaggtaaccccctccaggcttctggtttgtgcaatgagatgggggttaaccaccaagctgggggcagtgtgggaggaggggaaaaggctgagctgcagatgcttctgagagactggcgtccattggagctagagaccaggggtgagggggtaaggagacgccacctgggtcgtgtggtgagtgcaggcctgaagcagctactcggagccacaccttctctgtagctcctttagcacgacgggtgccgctgctcccactttccagaagaggaaactaaggctcagactggaaaactgcttacatagagttccacagtggcagaaccaagatctgccctccctgagtttttctcacttcaagctgcctcaggatgcctctctggctcgaacctggcccagaggagaaagcagagccacccacatacacagctgggactacagggagctttaagcatctgacaggcccttggtgggaagcttcccctgcagaggagaaaagggctaggaaggcagcctggagatgagcaagggccccacctccccatggtcagggccactaatctcacgctccttctgtgcattatacaaacttactctgctgggcccttcacacccaagaaggagtgctgttgctattcagtcgctcagcctgaactgataccccatggactgcagtatgccaggcttccctgcccctcactatctcccagagtttgctgaagttcatgtccattgcattggtgatgctatccaaccatctcatcctctgccaccctcttcttttgcctccaatctttcccagcatcaaggtcctttccaatgagttgggcttcacatcacgtggccaaagtattgctgctgctcccattttacagctggggaaagagaggcccagagagaggacagtcaaggtgagtttgtggcaaaatacagaaagccagggatgtctggtgccaggttcccagctcactctctccaaggactggaggggtttagtgagcagctaggggaggcagagagtgagaagccctgggcttaagggctacccagtccctcctatcccccatcaacccctcagtgggcctgggcctctggggtgcagacccgaggggatggggagaaggatggtattgagtctgccaggaagcttctgagagcctttgtggctacctgagcatccccactagcatctcttcactcttccacctgccctcacctccagagccaggcagcctcttgagcccaagcaggggaagggagaaggctgacagaggtctttccctgcccgcatcgtgcctgtctattcagttatcctcctgtcggggcctttgggggcagtcccgttggtgctggaccctctggtccctttgttcagaagagacctgaacaaaggggaccgagaccaagaagcagcagccagctcaggtggggagggaacaggaatcctgtggcccacaggagggtgactgctggcccagcctggagaaaccacacgctggagaaggccaaccctgtcctgtgaaccttgggatttgcaggtgtgatgggaagacccaactgcacagaagcagttgcttccctgcagaccccaagggatagcaaggagagggcagagcttagagggtcaaatatgtgtgtggggatgccgaggacaaggacgaagcagaaggggtcctggccagcagggggcgccagcgcaacagaaatccaagcaggtggtttgcaaggagcctgaaggccttgtctcaagtccggaggttaccagggctagagcatgatgctagagcacggaatgaagaggcacccactgatcagacctggctgttgaagcacgaccccagcacagggggcccggtatggtgtcataaataagagcccagccttcagaatctgcaaggacagatgagttggaatcctggttgctgctgtgcggccttaggcaagtcttttcctctctgatcttcagtccacctccataacaggaagatgctcattgcacttccagcctggggtcctggcgtgcagtaagtccccagtaaatggacaaagtgcttcataaaaaacaaagaatgcgttcagacgtcaggactggcaggaggatgcccacacccgccctccccccacccccagccactgacccagggtcctttaccttcccatacaggttggggtgggtacccacttccttcagagccagagggggttcagtgcaggaagaaggggcctcagggacagaatgccaggcaacgcaccagggatggagctgggaccttggccacttgacaggtttgcttcatttgctcaacaaagttatcaagcattcatcaagcacctgccccctggcaggctctgtaccaggcacagaagtatcaggtgagaaggcacacagacccaggcagtgacacctcctgctggccccaggcgggtggggccgggttctgcccctcctggcttgcgctagttggacacatcctggggccacttgagccacaaggccccgctactgcccaggtaagatgacctgtgactcagcagtcaaaggctcttgaaggctggaggtcagggagtgggctggcggcagaggtgggcatctcccactcttgtgctctcttccctgcaaaggccgctgcttgcagagactctggagctgacaaggcttggttcacatccaggctttctacataattcccagggcccctgagggagtcaatttctaccctctcagccccagatgccgctaggagaatacaggaaacactttaaatgatttactatatgatttctctttctctttcataaagaaagctcctctgctacaaactaaccctgtgaggttggtattggtacccagctatagcaaaggaaaggctcagagaagttaagtgacttgcacaagatcacacagtatatatcaggcccatcaaactccaaagcctatattccttctagagcacatactagctcagggcagattgattgttccttcttgataatgggctcatctgagaccaaaagaatcctcagttcgcagaaagctgtcagtgatgaagggcccttctggggtcctgacccccaccatcagaagcctaaggtcttggttgataaccctggcactgttgcagactggatgacctcaggccaggtcaaggtccaaagctcataccaagccccaggctcccgctcctgaaatgcaggggaggagttaagcattggacacagcattcctggcctttctctgcttctcacctccacctgctccatcacacagactgacccccaggcttccctctccagggaatccatgagactagcccacacaaacatggcaagaagctgctctgctgaaaggtgctgcaacttctcagaagcatagtgcctgcccggggctgaggctgcaggagctcagctgagatgccttcctgatgtatcttgagtttcccctgaggatttcctgcaggtcctcgaagcagaccttccagctgaggaagctctgcatctgggaacacaagagaccctgcgtctgtctgggcagagagacgcagtgggctgaagtcttccctagcctgttctgggcttatgtcttggtcgctggcactgctggattctcctggccacaaaggaggtgagaggctcagctgaaattgtaagggactcccagacctgagatgctccaattgtaattaaattccctgatcaagccatcagataaactggattgccttcacaagagcacagaatcagccagctataatgccagacccacagctcctcttccccagcctgcaggatgatccagcagggggaaggtactgtcattaaaaaggactttggggagagaacaaggaagaatcagatgtggaagagaactgctaggacgccccacagccaagcctgaggtcagacggcaagtgcccgggaaggaattcctggcaagcctgcgtcctcatgtttcaccaagacgtccaatgtgcctcagagaaggacaacatcagtggctaaacatctcttttccaggtgggatctggcagctggaaaacctgtgctgtagccagagtggtaccctgggttcttgtttgcatccggagcagttttagttgcataaaaaggaaggtgtgtgtgtatgtgtgcgtgcgtgtatgagggtgtatttccccctcagtataacattattgctggttaacaggataaattgggaaaatgcaactacaaagcgaaaccacacagccctgtctcccccaacactttcagccttctagtgacttctgtttgtcctcgggctttagaacactctctgctgtctccctcagcacagttaagattttaaagtgagcattttcctctcactctgagcccttcctctgcccaaaggctgctccctggttcacagtcttaaggtcgtttccatcttctgctattctggatacgcctaccacaggtgcctgcatgtgtgggaagcttttcccacgttctgaactatcccctttggatgaaggctctccatctgaagatcctctttgcaggttgattcttggagcctgtgagagctggagaccatgcctcccaacctgggagccctccacgttctttgtccccaaaatggccagagggcatacctgcgagaatttcccttctgctcaaggcccacagggatgcgggtgtcaccccagtggccctgaaaaggggactgaggctcctgaggagacaggttctcgtttgcttcatgtatgaaaaagcagcccatcagctggagatttctctttggggttcacggtcagacgcatgggggtcttgtctctgtcactggctagctgtgtgactttgggcaagttacttcccctctctgagcctgtattctcatctggagagtggagatgataatggcacctacttttctcgagtggctgtacacatgaagtgcaatgatgcaggtaaggccttcagcccagagttggctacagcactgtaagtggttaacacattggaaccattgttgttactcagccgctaagtcgtctctgactctttgtgaccccatgaactgttggttggaaccacagatggctactttagctgcatagccctttcagtccaaaaggtgtcctctgacttctccgggtgttcatttctccagggctaaatgggactgaggatgatttctgcctcccagagttgccagggagcaaatgagcccactgggataagaaggaactccttgtcaactgcagagcgcatggtggtcatttactttgcttgttgttggaatcttctggtgggaactcactacctatggatggggccccaggggcagatctggctaatacagcctcctccaggaagacaaagcctgtctctagctcttcacaagctggctccaacttccacagaaaccccccatcccaacccccgggatctgggttcacacagcgctgaggtccagccctggatgcatcactcccatctgtatgtccacgcccactggcccttctgtccctcaggcttctctctgtaaagtggtggctccccttctgccttcttgttagacagagcaggtgagctcacagtgcaccccgtgggtgctcattcttcatacatttccttttccccgaagatccacaggccagagggccccttctcccagctgcctgggtacatctagaatcaccttcctggtgctctgcccgccatgcctgatgtgaccagagtgggggccaggctggtctgtgaaggtcagaggtgtggatgggctcggggtccacagagagggggagagcaaatgagacccagacatgccagcttgtccaggccctcccccaggtgaaggtgtagcctgggatgagagagctcttaggggggcggcaggaggcgggatacacagccctgccctgtaccagagctctcacagtggagagctgtggagtgtgtgagtgtgtgtgtgtgtgtgtgtgtgtgtgtgtgtgtgagtgtatgtgcacccagttcagtcgctcagtcgtgagcgctctgactctttgtgatcccatggactgcagcacgccaggccgtcctgtccatcaccaattcccggagttcactcaaactcatgtccattgagtcggtgatgccatccaaccatcttattctctgtcgtccccttctcctcccgccttcaatctttcaagcatcagggttttttccagtgagtcacccacctgcaattataaaaccagatgcagtcaggaatgtttcaggagtgctggggggctgtggcagaggtgtgggcagttgcccctggggttagggtgtggaggcagaggtgggcttctggaggagggcatacctatctatgggagccggtgtcttccagggccctgagaagcccctcccgacactccccttggtggtggctgcacagctcccgcccagaagccagaaactgaccggaagggcttaaggcagtctagactccctcccaaggagcccgacctggcctgctcctacctcctgaccctacccccatcaccttaccagagcctgggggccctgggagtgtggtcagggagctctccccacacccaatggccagggaccacgggggagaccggaggcaagacccaagaaggcaggcatgggtgaaagtcaggaagcccaggacccaggctggtcttcgtgggcgcctcctgcagacctggcagcctctatgcctgaaacctcacagcaccttccaagggcggtgttgtcatgacccccatcttacagaggaagaaactgaggcccgcagaagtgacagaaccattctcccaagccagcgctgagccttgagccccatctgtgacagagtgtggcacacagagcccctcaccatgacgctgctgtgggccagcttgcgagtcagtgtgcccacccctccccccgaccctgtaaggcaggcggcttcagctcccactaaacaaacaggaacaagaccccccaggggcactgccctctcggagtggagctggctgtggcaagtgaggactcagggcttttattgccatttcagacacacaggaaggtcaaagcagacagaggggatggccgcagaggggcctggggtctccccactgggatgcctcagctttgaccccacccataaggacagccatgtgcccttctcaaccaggagggcaggtgtgggaggcctccaggacatgagatgggtcagcagacaccacctggcctgatgagcaggtccacccagggtgacctcggcctggcagtcacagcccagtgccaagaggaaggcctgggctcgctggcatttccagaactgccaggcaccagggtgggggcctagggttggtacccatcacagctctcagctaatggctgagatgtcaatccaccctccaaagtcggtccaaaataacttaattagcttgaaagagctgctggcagcctgccaggatggggtgggggaagggtagcaggacgagggccccccaacactgcagggaagaaccttgacaggaagacaagagcacccccattctgtggactgtaccctttcctcatcacagggactcgacccaccatggctctgccaggtccagccaactgagcccactggacagatgaggaaactgaggctcagagggggccaggatgcgctctgctgtattcatggcagatgggcactttgaaagtggggtgatgctacttgggggcaggaaaagttcagccctagaaaagctggtggggtctctagggagagagattaaggtgccagcaacgtaccatcaagccagagggatcccaggttgacatcggaagggacttgaggctgcaggaaaggacctgagcctaatctggaagaaaagagtgtgtggcatgaggcagtatccaccttgagagtcccagcgctgggggtccttgcccctctggcagagggttttagccagagccaagtctctgatagggtggcacctaggatcccctgctccctgcagcccccaggacactgggagcccaggcatggcggtgatcgggtgcgatcagggtgagacagacacacagccactgccctccagaccctgatgctgccctgtcagtgccaggctgggcactgccccaggatcacaggcaagggatggctgtgtgtgtggcagcccagagaggaacatgggacgcccagtgagctggagctctgccccaggtgtctgctccaaggctgagctcactactggtcccactggacacttgctcctcccacctcagagaatacactccgtcaaccacccaggttcccaagtcagacactggctgtctccctcctgctcaccccacccccagtcctgcccaagtcacctcccgaacttttgtaatctatctatcctgcaccctgtcccccatcccacccaatccagaccaccactgtccctctggatcgctgccaagtccttgtcacccatttctctggtctgcacactattctctctgtctctctctcacatgcatgtgccccatgaattatcaagggaatctttccaaaactcaagttcaaccaggtcagcctcattgccctccccaacctggccttggagactggggggattttcccactcacctcactgaggttggaacagagcaactgaaaccctgggctccagatcagccaggtctgggtctgcatcctgggtgggccgtttggtgactgtgtgatcttggatgagtcacaccaccttcctgagctctttcctcacctaggaagcaaggctgccacgaccttcatcaagaagaccccatggggcaccagggtggggccatgctgagcgcccggctcagagcagccacaccacgtggcaccaacgggcaccggccagctcccggctgcctctcaacacccgcctcacgtgctgcaggctgtgacctgacccggcagctggtcctccctctggctccaagagccccgtaacaccttgctctccacctatcggttctctggcctgtctctacctgtgagcaggagtagagcctgggacaggctcgatttacatttgatgaatgaatgaatgcagtacgagtgtctacagagggacacggccacgtagagaggcgcacaacacacacagccacctgcggctcagacgggctgagggccagagggggcccctaggttggtccattattacacacccctcggtgcagcccagctcagcttgagcctaagaagaaagctcaggacctgttttctgagggtccacgagggtgtgtgccctgcctccatcacgaggcatctgagcctaccacactcgggactacaaggagcagcccagggggccacagcacccccctgggcagggctgcctaaagtgggggtgcggggtggagtggtggctgccagctggcgagcgcctgggcctggcagtgccgccgatcgcccactcgcaccagctgttagtttccatggcctgcccaccagctagccaggatgctgggcccgggctgccctggggtgtcctgccaggaagaggcagcctctaggagggtggcctgggcagaggggagggcagaggaggggcaggggaggatgaggatgccaggctggaggaggccagggccaccctccgctcacagtgtggcccggaacaggctgccgcacttccagcgcctcaggcgcctcttctgggcagtccatgaggggccggaggtggggatggtgcccagggctcctccctccgctcaaaacacccagcaacagggattctggaccctcgggaggggaggtgctccgaggtctgcgaccacaagagggcgcccgagcctcaccttgcagggagccaaggcctgaggcccgcggtggagctgtgcctgggagagggcctgggagctgggactgaatccctgggcgtggcatgcagctacctgcgtccattctcaggcaagaccccatccacactttagctcttttttcaactgatggcaacactacctgcttcagtatacgtctgcagagtaagcgcaggaacacgctgctgctaagtcgcttcagtcgtgtccgattctgtgcaaccccatagacgacagcccaccaggctcccccgtccctgggattctccaggcaagaatactggagtgggttgccatttccttctccaatgaatgaaagtgaaaagtgaaagtgaagttgctcagtcgtgtctgactcctagcgaccccatggactgcagcctaccaggctcctccgtccatgggattttccaggcaagagtactggagtggggtgccatttccttctccaggaacacactaattgaatgataacggtgatgtagtattttaccgatgaagagaatggactcagagaggtttagtgatttgcctaagtcacacagcagtaggcatggagcaagttattccctctggtgctgggtgctggcagagctttggaaagagtcctggcaccaactcacagggggttagcagcactcaagtcctcagggtagggaccaagcctgattctggctcccccaggtcaccctgtgccataaagaccagacccttttctgggcaattacattaatgaaaagaggtcccagctgtgagccctttacacacccatgaggcatcctcgtcctctgactcacagatgaaggaggaaggcatgagagaagttaagaacttgccagaggccacaaagcttagttccagtactttggccccagaatccaccctcccctcaccatgctatgtcctggggaaactgtttttcccaaaggagcttctggccacctccgtccctctcctgttcacccaacagctttcccacctattcagttggggcagaggtgaacaccaggcccggccccatggaccgaccaccacccaaggggagacagacaaggtgcacatgactcattcagggccggagggcccctaaccaatcaggggtgtcagggtcttctgtggggaggcaaccactgagctgagttgcaaggaaaaaatgtagcacaatggcccttgctggcctcccattctgggcccagggggagctcgtgagttgggagaaactggccctgtgtgggtaggaggagtgggcaccccaagggcgagtccaggctggttcccagcaccctccagcacctggtcatcacaaagtcatggtgggctcatcaaggaatcaccactgggttgtgattggttatgggtgttcatggagccaagccctccaccagccttcccgcctttctctcaggatgggtaccccctagggcttcctcgattctatggggaccagagttggcggggtcaccaccctctgggtacaccgggcacagaccattgggccaccaacgcagcacctggagcccagagctcagagtctgagcagagcctggctggagggattgggggcaccagccagggtcccagcctgctgccttttgcatcaccagcctggagcccagcccagggccggcacctgtgcctcaaggcaccttgaggacctaactgcgcccctctgagaccctcttcccctaatggggcagtgaaagcacagccagccccagtgctccctgaccctcctggtctctcagggcctcctgtgtggttctagaagcaggactcaggctgtggcagccacctctctccaccagtggccaccgacactgaggtgcagagggagcctgggggctgtgaaggaggctgctccccctcatcgtgccagcagtggtgagaatcagacttccccgttcaaggacccccagctgatgttctttgtacccctgtgcccagccaccccctgcccctcagttctggggtccgtcagcaccaacagccctctcctcctctgcactctcccagccatccccaccccggacattgcctgcccccagaaccgccccctgatatttcccccctcccacccaggactggcttctctgtccaccatcctccaccctccctgttgggctggcttcactctcctgaccccgctctctgacctcatctcacccccctttcctcctcctggactccctccttatccagcctatatcccaagggacctttctgcacccagagtctcgagcacaccgaccctcaaaaatctcccaccccattctgcaaatgcccagcctggggcagacccacagtgctcctcctagaggatcccatctgtccccaggccccagggtccccctcccttgtctctccccacttcttccttccatcaagaaacacactcacctcttgataatgatctttcaagctgctctcttagccctgcacatggctccaactgggccccattccttctccccagcctggtggagctcttcaagcgttacttgtgtgcccatctctgcctcctcagccccctgccctctgcaccgcagtccaccaaaactcttctcatccgtcactcctgctacatcccgagagagttgggttcccatcccaggctggggccagagagctgtgccctgctctccccctcttccctgccccctgctcgtctccatggccccacgccctagtgaaggtcccctggctgctccttactcccccagtaggtccttctgccatcctgtcccacagacgacggagctctcttctagccccacatgatcatcccataccactgccccctcttacccggtaccaatgttcccaaactcgccaaggcctgtctccacgcccagggatccaactgcgtcttcagtgtgggtcaactccatccaagtaacttaatcgtgacacagtaacttcatgaaggaagtactattattatccccaatttgcagatgggggcaccaaggcacagagagagttgcccagggtaaacagctgatcagcctctgaaccaaggtctccttcctggagatccctcaagagcctcagattcaccataaacagaacaagctcacgggctctgcactgaatgtcttcttcctggccaagctggcctttggactggacagtgacaagcgtctggaccgtgggcaattttactttctgtgggaagtacttaacccagagctcaacagcagtaagtggccagtacaggccagctgctgttgtcaccatggccctccaaacctcagctgcttctagaagatggggctattgggggaatgtctgagctcagggcctggccacacgggggagactatagccctggccactccgcacaagagcctttttgcagtaagtcaaagcagcatcaatttataatgctgcaagtttggcacaaatgcactatttttcttaagccaaaataaagctccaataagctgtaaaagccctggagttgggaggattctctgcggggtcatttagggtgagttagaacctgcagctgtgaactcctcagccacacatggcaacctgggtgggtacaccccagaatgctaatgaaggcagctgctcagggtcggggagccagctttgctctggcttcaggccccagggagagggaaagccatgtggggtgagacaggacaggacctcagccaccctgggctgcgtgatctgggccaagcccgggccccactccaagctgcagcttcttccgatggggttccgaagcatgactcagaagagggaagttcagggcctggggtggggacttcgaatgatgtgtgcaggcattttcattccttgggcagagatctcaggatttgtaatagtgttgtaggaaaaatgggattaaacatgccaatatttgcttatgtacacaaccgtttccataaagcaggattgtgccccatctcaatggaagcaaccccaaagtccttcttgtttggggcaggtgagcatatgggaggctggatttgatcccaaactctgccctttgccaatcatggtctccccaagggacggttccccttgcccgttccacaggtgaggagactaaggcctgactctaaaatgcagcatcttaacttgtgtatatgcatgtgacccagctcccagtctctctgacctctggcttggtgaggtcacctctgcccgaggccctgcaccctcccccaattccctggtgcctggcaaagaacccagatcttgaaactccagagctcagctctgcacatacaagttcacgatcagaaacaagtaggtaccctctctctgggcctccgtttcctcctctgagccttggtaaaatgagggtgatgatggtagctaccccaaacagttaagctaattcatgcaaaacacccttgtggtgcctggcacaggataagtgctcaaccagcattcaatccgttcaggagataggatctatgacttctactctgaagataagtaaacagagaattggagaggtttggccacttgtccaaggtcacagagctcaggagctgtgatggcagggggagggtgtgaggggggcacgagctgaggctcaaaccaggtctccttgtccccatcagggtccagatggaaggggagtcaccgagccaaagcccccagggcagggacagggagagaagggaaggaggagagaaacaggaaggctaccaggacagagacgggaccgggagcaagctactgcctggggcagagggcccaagcccgcaggggtcacggggcacggttccccgggctgacagtgggcactctcaccttcaccctgttctctggtggctggtgaccttgacaactcaacctgcatcactcacatcctagtaaggccctgaaggcagacgttttgggggtggctcatctacatgacagcctcccacaccttgagccagagccagggtcctgccccctcccctggagttcaggagcaccctgcccacccaggggctcccattctgggctgcaggggcaggaggtgagccggagccctgagaaaccaacagcctacctacctgaggtgacctccaaccaacctcaagacctagggcacctagagggtggggggagcctccacctacagcagccagcctccatgtgcccacccgcaggcctcgcccatctctgctgacagctgggaattcctgccgtgtgacccagtcagcctttcagggctgggatcctggcccagccacccagacacggttatagctcaggctgtgagctgcctatgaggccagggcaagtgattcccatctctgggacttggcttctccaggtcagaggagggatgagctgcgagctgaaacaactcttcccacccagaggatctcgggatctggaatcccagaagccaagtgttggagagaacttcgggctgcgatttcctaacactggcctgcagcctgacaaagtcagggtccccggggagtcctgtgaacatgtacacgcgggggctcccttccacccccagcagatcagcagatgcggagccgggtgttctgcagatttagctagtgccctgggtccatgccttctgctgactctcaggggtgggggcaggggaaggaaggggagggtggggctgagggttcttcccgagacaaggtgcccagggatccctgagcctcccaaaatctttactgcttcatcccttgagtgtcctcagaccccctcccgcccgccacccagggctggaatccagcctttgctcccatcagcaactcctccacagaattctccaccagcttctccccatcctggtcctcttcacccaggagaggccacagctactggcccttccagcttcccctcccactcaaatcaggggcctgctttttgttttcttcctctcaagcctgcataaagaacactggatttagatgaacagctctgtgcacaggccctgtctgggccccatgtaactgccaccctgttgagctctaacacatttcctccaccccaaagagcccccagtcaagccccctgctcactgcacctccccggcccccctcagcagacctctagccccacagattagaagggagaagcctctttctaagcagctcttctgtgctcatcaggttggactgaaacccctgaggacagcaactgggctgtcctgctggctggcagtgcctggcacagagcagacattcgggaagggctgtgagaggaaggacaaggtggctgcaggctgcacccctgctccagctgctgccgtgatgagtctccttggctcatcatcccagcttccttcaatgtctaccacactctcagcccccagccccctgcaggacgcctggcacatggacacgcaggtgcaacacccccacctgccccggccaggcctctgtcaatgctcagacacctctttccccacagggctcctgccccatccccaagccttggctcccagaatcctggaatcacaggcacaccgaattcctggatctgcactctccccagtgcctccagcccctacccactctggcctcacttgtcctggcaggctgtcttctgtccctgtcccagcaccgtctcagcccccacagcaactcagagcctccgcactaagctattagcaggaagtcagctctccctcatgcccacaggctcccgcatgtgacctgcgacgagcaccctcccctctccaagcctcagctcctccgtctgtaagacagccccatcaggctatgtggattcagtggactcttctggctctgatgtttcctgcagatcactgcccacggttagtgtaaataaacatttattagataaataactagccccaaagaatgagtcatcattgatggtggaacggtagacatcagctgcaggccacttagaggcagaattcaagagtggtggtgaaagctggattcagactgcctgggttggaaaccctggttcacgacttcctcatctgtaagatggagatcacagtagggcagggtgaggatgaagtgcgatagtgtacagaagcagccagaagagcacctggcacttaaccagcgctcaggagaacttagctcccactggtacccccagcgccactgtccctcagcaaggctcgggagtccacatcagcgacctgcgggtggagccaagcgtagcagcagtgcctgactagtgccaccagagggcaccatgacgcagccaaagccgcccagctgaaccgagggctccctgattcatcctgagtggcagtgccagccagaagcctcccagctgggaggacgagggtggggcctggatgcccgaggagttctttctgcaggagatgcccgcaccaccttggcttgatattctgcccattcctagcacagtctgtgaccaacagcaacccaaagtgtccctaatccttccctccagagccatcagacccatttaacagatgaggaaacaggcctgagagaggccagctccaggtcatgaggtgaactctggccttcctgctcagactgacctcccagtacaccccactaaacactatgggtgtggcgcccacccccacaaccaaagctgggagccagcacctgtgcccacctgacactccttgggcagaggagagacaccagggaaaaaagcacatctaatggtggggagacctcaaggacggagggcccggggaaagtgctggatgtgagaggaagagacaaagaaacacgaggcgaaacagggtggggtgggcacggaagacaggagatgcaggagagacattcgagaaagtgaatgggtggaaagagacagacaggggaagaggcacagagacagagaatcccgagggagaaggcaaagagagaagcagaggcagaaggacggagacagaggcagagggagcgattgaggaaaagagagatggggatggggtcatggtgacagagagagacgggaggcagacccagggacaaagacctgtgggcaggggaccctggagggccaccgaagcggcttcactctggtctggagcccccatgccctcctcccaggcactcagccagagctctcgcccttgcatttctgtcacaccccctaccccagcagggcttgccagacagacaccccctcttgggggtggtggttgagccgggttccctagggcatctaaggcagacaggtagggtccctggggccgtgttgctaggagatccagcccagggccccagcctatctcctgagcctctcctagggcaaggctcaacactcacctaggggctcacctgagacctggattccccctagctttcaccccgtctggccctggacagcctctgccctgcatcctcttggcagagggaaggcacacctggtgacccagccggttgccaggcctccctggctcctgccccaggccccggggcctgctgtgttccttagaagcactagattcccgggcttgggtgcaggtggcagggagattgttcaaatctcagcctgccttttaccagctgtgtgcccctgggcaagtcactctccccctctgagtcttatctttaaacaaaaataataacagtatccattccatagggtcctctagaggaggaagagccataatgagggcacagcaactgggatgggagactggttttaagctccatctctgagccacctgggctgcagctgggagcatctccccgcagtccctgtctcccctttgcacctccttgagcaggctagagtctgattcacagcagcctcaggggaaggggctgcccagagccctcccagggaactcagataccaggagacatgaacactaggggcccaggcaaaaccacacccacatggttgttcgggcctgtgtgctgctttggggccttagatgaaagcaacttcagggcttcccaggtggcgctggtggtaaagaacctgcctgccaatgcaggagacataagagacatgagtttgatccctgggttgggaagatcccctggaggagggcatggcaacccactcaagtattcttgcctggagaataccatggacagagaagcctggcaggctacggtccatagggtcacaaagagtcggacatgactgaagcaccttagcaggcattcatgtaaaagcaacttagcttccaggcccagttggcctatgggcaggtctgaccacagtctccattttacatatgaagaaacagacgcaagagctgtgcctttgcccaagttttcaccaacaggtctgatgcagctgatgcnnnnnnnnnnnnnnnnnnnnnnnnnnnnnnnnnnnnnnnnnnnnnnnnnncctccaggctgcggctcacctcagtcataaatctgaggctgcagtgctggccaggcccctggcaggcggcagggggcagctccagggagcattggagcacgccagcaagaggagtcccttccccagccaactggaactcccacttggaggggatctaagaactgggcccccagctaaggcaggggcttcaccaggatactctgggattccaggacctacacactgggcattcagcccaaagtccctgacctggggcctgttctctgcctgtgccacttcattgcctcggatctcagcagtgtcagtccaaggcggtgtgtgggttggagggggttggagcatttatggcttcatgccttccaagtcagcccatggttttgtggaaatagatacttgaggtcgaggccagccctctcccaccctggccccctgaaccctgcaaacaccttgacctttcacttaaaaatgtaatgagatgaaagaggccagcaccatgccaggctgccagcatgagcccatccacagatgccagctcccttccattccctctctctccccactggcactgggcacagagtcaggctggtcaggagccttctggatacttttccagggacactgggcccttggccagaaatgccttccctgggcctcaggagatgggtcctaggagctgaaaagagaaccagaggggccattgggtgggatgggatgggggggccacctggagtagggggacacatgtgtcagccacgtgtctggatggcttcctaggtgaactttcaaccagcatcgcccaccctcccgctctctggcatgtgggtctcagggggctcctgatgcaccttccactgctttgcctcccttccccccagaccgggacaccctccaaagtgagctcaaagcctggctccagctctttctagctattcaacactgtgcaagtcacagggctgtgcatgaggctgatgtaagacaaaggggcatctgagatgcaggtatgatctggagaccggtgtggtcctaggtctcaggctgtctgtgagagaccataggagagtgtggggggccatgggcagaccagctgggggaagagggatgtgagtatgcaagtgtgtgtgcatgttctcacacttgtctctgtgcacacatgtgtgtggtgtgcttgtgtcatgtgctcatacatgtgtgcacatgcacacacgtgttgtgtgcatatgtatgcacacatacgtgtgtgggcacatagcatgtgtacatgtgcttgtgtccatgtcatatgagtacactatgggtgtgctctgtgcacacgtatgtgagtgcaagcatatacatgtagcgtgcaggaacgtgttgggggcactgcaggtgggtcttcctggcttccctgtgtccttacccactttgattccttgccttctccctccctctgtcttcctcagctcccaccgctccctgcttccttccttccaggaggcccagctgcctggtctccagacagtggcccgggtggcagtgagtgggagctgatcacactacgcactcacgaggaccctctaatcctcttagctcccactgaaccccccggccccccggtggagacagcccatgcccaaactcagctggcctggggtcaccacagcagaggctcatgggctcccaagctggccctcagcaggttaattagtaacaatgaaccccaaatcctcactggggcttcagagggatacttctccatcaataaggcccttttctggctgtgatcccttttggtcctaacagtctcttttgaggtggggatttgaattgcacatttgatggtgaagggcattgaggccttggagagggagggggcctttctggagatcacacagcaggtcagtggcagaattcactcaactcaggctgctcccacacctaaggcctcacggaaggctcctcccggagccccaaccccccaaaggggtccccgctctttgcctcctgcctccacccaccatcccaggtttcctggaatctgactcttgagagacctaccttgcctccgtccatcccttggggccaggggtgctgctcagaaccacctggtaacagtgcagcctgcatgccagttccctgtgctgccattccagagctccagtggctcgttggtcacacagcagtcagacctatgctaatctgctcttgcagtgggagcacagagagctggcatcaccccccaacaccccacgctcccccgccctccctgtccacatcagcacctctgctttctcttcactcacagcacccagaccactctggtttccttctgacttcccatcactcccacggttttcttcttgtaggttttgcaccctcagacccttgggcctgcaatgtctcctccagaagctcttagtctgcctgacccctcagtgctgggcctcagtgtccctgccccggagaaccttccccgactcccagtctagactaagcatccctgccatttgtctccaaggcacatttcccagtgtgcctgaatacatccccttacgtatttatttgcttcatataagtctcgccactagagcataagcttcttgcctgatgtcatgggaactcatatgtccctgtatgtccaacataggtcggagagatgctaggagcgtagtagagtgtaagtaactcctcagtgaataaatgaagggaggagagatgaacaggcaggatgttcctcctacacgcctgcatgaacgaagagctatggggtagagagagctgggagagctgctgggtctggcagaagcagccctggttaattgctcaccctccaggaggaggtggggaatgggggttcacacacacccccagccagctctcagagaggtcgtttggcctcaagtccccaccctctgcccccggctctgggctggatgcctggcctctgcctcctgagggctctcctcctttctctgggcacccccaggggacaaggcccgtttcctctgggcccatgtagactctgattctatcccaggctggggtccttacttgctgtgtggccccggcaagtccgtgcccatctccaactcagctttctcacttgcactgctgctgctgctcctgctaagtcgcttcagtcgtgtccgactctgtgcgaccccatagaccacagcccaccaggctcccccgtccctgggattctccaggcaagaacactggcgtaggttgccatttccttctccaatgcatgaaactgaaagtgaagtcgctcagttgtgtccgactcttagcgaccccatggactgcagcctaccaggctcctccatccatgggattttctaggcaaaagtactggattgggttgctattgccttctcctcacctgcactgcaggggagttgaaaaggatgatctctgtctgtctagcttccaaggaggcctccgactgttacctccggtattcacacccctgtgtaatcactgaagagactgaatcagtgtaacagatggagcggcgtgaacgtgagagtagggctcccgaagcacaggacagggaggctacgctgctcctctgatcacaggctctggggaccccagtcgccatgtggtaaggatactcaagcagcccagtggagaggaacggaggcttcccaccaacaaacagtaccaaccagccaggtgagggggttagtcaccttagaagcagatcctttatccccaggcaaatctgcagatgaccccagcccctgaccccagccccagccaagatcttggctacatgagagaccctgagccagaaccactcagctaagccaatcccaagactcctgatccctagaagctctgtgagataataaatgctgattgttcaaagccacaaagttttaaggttactggctacacaaaataaagtaatgaatatatttccaccttctgctgcctacccccagagttctggtctgaatcattggtctttcagaaaagccctaggttggtgtcaccaatgtcaaactcaactaagttcagggaggagctcatcatatccccccccatctacttccacaattagccattgccaacggacgtcctctagaatcaaagacagatacgtggtgtgcattattgttcagtcgctaagtcatgttcaactctgcagctccataaactgcagcgtgccacggttccctgtccttcaccatctcccagagcttgttcaaactcatgtgcattgagtcagtaatgccatccaaccatctcatcctctgtcacccccttctcctcctgccctcaatctttcccagcattaaggtattttctaatgaatcagctcttcgcttcaggtggccaaaggattggagcttcagcttcagcatcagtccttccaataaatattcagggttgattttctttaggattgactggtttgatctccttgcagtccaagggactctcaagagtcttctccagcaccacagttcgaaagcatcaattctttgctgttcagccctctctgtggtccaattatcacaaccatacatgactactggaaaaatcatagctttgactagacagacctttgtggtgtgcattattgccttccttatcccagcattcagccactgacaaacttggcctcttttatctcctgcccatctctagaatcctccctctctttaccaagcctaggtgccctgccccagctcaggccacaccctctcttgccagttcagcggctcctctctagtctccctgcctccatccttgctgctcttaccacccatccatcctccacactggccgctagagggagggacttcctaaaacatagatctgatcatgatgctcacctgctcattaatcttccatggctcccctgttgcctaaggcccgaactccttggcctggctttgaaggccttttttcatctgcccctaccccttacctctccatcctcatctctagtttttctttgtctcagtgttccattgatactgagccacctgcaattcttggaacacaagagtttcatacttccacacctttgctcacacagttctctccacctggattcccctccccttctttacctggaaaattcctactaatctgtcaagccctagccgtctgattctccgtgaggagctggtctctcactgcatcttattggactacaacaaactgtttacatgtctattcacccacaaagtgacaacctccaaagcaggatgtctttttcatctctatattcctagtaccttgctcagtcccagcatacagaattccataaagttcttaaaatggaagacctttagattgaactttaaggtcaactcatttaaaaatcattttggatgggaacacctctaaaaggtattacagactctcctacctttttaaactagtttatgggacatgattgaaccttgctcgagtgtatggtttatgtcagtacaaaccccgggtttttcagaaggagccttggaggtcatccaatagaggaaggacctcaggtctggaaagatcacgtgacttgcccaaggactttgcatgacgaacgttaatgaacatctgagctgcaagacggtgatctctttgctttgatgaaggatgtcaagcccttgccttgccacggcactaaatggcccctttagtcaatgtctttaaggtttctgtatgttttagaatcatcccatttcagcactaggccagtgtacctggcccccactttacccctctagtttgttacttctggtccactggaggcaggaggatcaggtaaccaaacttgatggaatcacacggaaaggaagagttacagccctggcctgagacctgggagcactgctcctcgggggagtgtggcgggacgatgggactttgtggccctcctgcctctgctgtgccccagatatgacagttgtcgtgaggagagactgaaggcttgggctggttctggcggagggaagtgtcagcataaccaagagatcctgcaggcaattcactcccaggtagatgactccacagggaggacaaagaggcggatcctggaccctgggctccataagctcccttcccacactccctcatcagagacaaagtgcatagtgcaagaggcaaaaggaagcagggcctctggggtggggtggggagagggggactggataggtgggaatagctctgtttatcttatccagcgagcaaacgaatgagggtggaacaggaagcaatgaactaagagatgaggattctagtccagcttccactactaactggatgcatgtcaaggggcaactcaactagtcaatctaggtgtccgtttcagaatctgtgaagtggggatgtgtgtgaaagttttagtcgtttagtcatgtccgactctatgccactccatggactgcagcctgccagactcctccgtctatggaattctccaggcaagaatactagaggcggtagccattcccttctccagggatcttcccgacccatggatcatacccacatctcccacattgcaggcagattctttaagatctgagccactagggaagccctgaaatggggataattcctacatcatggggttatagtgggattaacaaaaataatgtaaaaaagaacttagttctaaagtgctgctcaagggaacatggccttcattcacgcattgcacaaacacttactgattacctactatatgccagctgttccaggaactggggctgtggccatgaacatgacaaagcccaggtcccatggagctgactttctggggcgggagacacataaatgaataataatgtactaatcagtatctcaataaaggacagaaacggtatggacctagtagaagcagaagatattaagaagcggtggcaagaatacacagaagaactgtacaaaaaagatcttcatgacccagataatcacgatggtgtgatcactcacctagagccagacatcctggaatgtgaagtcaagtgggccttagaaagcatcatgacgaacaaagctagtggaggtgatggaattccagttgagttatttcaaatcctgaaagatgatgctgtgaaagtgctgcactcagtatgccagaaaatttggaaaactcagcagtggccacaggactggaaaaggtcagttttcattccaatcccaaagaaaggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaagaatactagagtgggttcccacgccctcctccaggggatcttcccgacccagagattgaacccacatctcctgtgtctcctgcactgcaggtggattctttacctgatgagccactagggaagctcctggtgtctcaggaggtaaagaatctggctgtaacgcaggagacccaggttgtaggttgggaagatcccctggagaagggaatggctacccactccagaactattgcctggagaattccatggacagtggagcctggtgggctacaattcttggggtcacaaagagtcgaacatgactgagcaactaacacttttcactttcaccagaacagaccggccctgcctcaataaaagatgagactctttcccagtcatagcaagttcctgaatttcagtccacgccttcaatcaaggctctagggacttttgttcattattttctttccttaagctatccagtgccattaaaagcaaacattccaccccacagtcctcagagtcctcctgccctttattcttctctgtggcacaggtcgtccaagcccctgatggcttgccttccatgggtacttcattttaggtgaccacaagggacactttaattagctgtttcagcactggggaccatgggcttctgggtctcctccctttgtgctagctgttatctcccagccttcagccctaactagggcaggagccaatcccagattcccaggattccctcggggtctgtgcctgcaccccaattacggcaccaagatttgtactaatcagggtacttgtttgcaaacaacagagagaaattctgtttgacatacactgaaaatacacaggcatcaggatgttcatcgaacctgtgcagaagccagaagaccaggcaggatccagagagacacagacgaggtcttgccacaggaatgatacctcaggagctgctccgggggtgtcgccaccaacctcctgtcccaccacaatgatcctcagtgaccctgcaccttaggccactctttctgttgagcagtcgagtgtgagtgtgtgtgtgtgtgtgtgtgtgtgtgtgtaggtgcatgcatgtaggtaggaagagaggaggaccagcgagtagctagctctcttatgggatttgtagggcaattagcactaaattagacgtgacctatgccaggctgaaatcccatctctaccatcaacttgacccagttgtgttatcttgagcaaatctctgaccatctctagacgggcctcagtttcatcatctgggaaatgggaacaatatccattcttccagcctcactgacgtgttgtgctcccacaccctccttttctcatggataggacttagttcaatgtataacgagacatttatttgtgaaggtaccactaatgttcctccagtagacggtaggctctgtgaggtcaaggacttcatctatctgcttagtgctgttaccccaacacctagaaaattgcatgaaatgtagcatgggcccaagaaatatttgaatgaaagactaaacaaggtaaaggatcaggaaggggatttgtaaatcgtcaagggccgcacatgtgtaagtgctggtgctttggagccagagagaccttgaaagtgaaagtgaaagtcactcaatcatgtttgactctttgtgaccccgtggactgtagttcatggaattctccaggccagaatactggagtgggtagcctttcctttctccaggagatcttcccaacccagggatagaacccaggtctcctgcattgcaggcggattctttaccagctgaaccacaagggaagcccaagaatactggagtgggtagcctatcccttctccagtggatcttcccaacccaggaatcaaaccggggtcttgtgcactgcaagtggattctttaccaactgagctatcagggaagccctgctgctgctgctaagtcactttagtcgtgtccgactctgtgtgaccccatagatggcagcccaccaggctccccggtccctgggattctccaggcaagaacactggagtggggtgccatttccttctccaatgcgtgaaagtgaaaagtgaaagggaagtcgctcagtcgtgtccgactcttctcgaccccatggactacagcccaccaggctcctccgtccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgtcttcttttcctctacacttaggggaagtcacccagtgtccccatgagttcccgccatcacctgcacaccagcctcagcaggggccccctgcccaagactgtctgggagtcatctgccccaccccctccctccagctactccaggacttactccagaactgcagttacacctccttgtctggaacctcgggacctgacccaagacccagcctacaatggaggtttaggaaacaaatggataaatgaatgactctctgttttcaaaattataaaaccaatctctgtctttgcttgaggacagagtctgaagaaatgacctaaacccacagaaagatgcactaaaattagaccctaacagaaacttccccagtcgtgttatttactaagccctacaggggagagacagagacgagggaggctttccttcctcctggggaaaagcgaggggctagggagaggaagtgagacccttgggaaagtatacctccattggcagggagctcattacttgttgaaacaggctcctccattaccaacttccttcagcaaccagagtccactcagtcctcatgtttctgatccctacccttcacctctcccaccatcccctctctaaagagagtgtgactttgcagagctggcagccagcaagcctgccaccattcccaaaagaagacagaccttcctaacagtagtggagcaggctaactcagaaggtaatcaactcctcgatggtggaaatggacacagacctgccaagagatctgtctttgtaacacaacctcacttatgggagcactttaagcttaaccttctctcttggccatttgcgctgggttttgaagccatttttccaggtaaaagctgaaggaagggcattcaagacagaaggaatggcacgtatggaagcatagagatggaaaacggccccatgtttgcaaaaagacaaatcatcttgactttcaaggccggaatgtggggccccaatatttactgagcacagactctgcacagatgcaggggtaggacctggagagatactgcaaataagacaaacacacagtctccactctcatggaatttataatctagtgggggaacagaaaagaaacagacaaataagtgtgggcagtcttttcagatggttccacatgctgttaaaaaaaaaaacaggtgacacagtggagaacgactggtggttggggagcacctctctgagcaagtgacatgtgagctgagatctgaaagcagcaaagagatagtcacgcaaagagcaggctgaagaagttcctagctagaggccagcaagtgcaaaggccctgaggcagagacaaacttggaattacagagaaacacaggaggccagtgtggctgaagagtagggggagagtacctggtgctctgctggtctcccctgccccaatctctctcttctgcttggacactgggtctccaagcccagctgagtgttcagagcaagacactcactccctgctccccagtccccactgcttcaggatcctggttcattctggcagcaaatctctgcccatctcagtcagctctgcaaactcagcctgctgcatcctgcataagcagcccagcatctcagcccctcctcccccagccaagaccccagcacccactccaacctcaacccagaagccagggttcaagcctggtccaaaggggctccagtcaccaagctggatagccctttagacccaaaccaactgaggagccagctctggaggacagtgtgtggggcgggggggtgtcaggagcggcacattgttcggagatggcagagccagacacgagatcccagactagatagagctgggaacgaggaggggggctgggcttggcgttcctgggtggtgatgccatctccccggcaatggagggcggcaggcaggagcctcccattcccccagaggacttgtcctccctgctatctgatgagggagctgtcggttacaggaaggcaagactgttcacaggacagctccagggagcaggaaattaacccaccagccagagacagggggaggggggctgggcggggcaggtaattaaggggccctgcaattactgtgccttcaatctgggccagagttctcaggaaggggatggagatgctgctcagtcggaggccccagctgactctggcagggggcatcagccctgtctcacactcttccttccgtttccattcctgtctcccctgggccccatccctacctctgtccaaccacaagtgatccgctcattctcatctttgcacaactgttcctcccaccctaaaggcctttcccactcactcgatcctgcccttccatcggctcatgcaaaggactgttctccaagaagtcttcctggagcagtcatgtcggaagggattgctctgagctcacataacacagcccttttgtgttacgataagggaacagactcagagagggcaacgatcggtccagggtcacccagcagaatcaggactagaacctgagactcctgcatttgggactggattttttaccaccaccctgtgagctcactaaccgataaccagcccaggcgtcatcacatgccaaccacggacacagactgaggaccacagaagggtcaaggggcccgtcgcatttatccagcatctacttgctctggattgcggctggggattgggaatgctgtgaccagcagacacagacacagccctgcctttagggagtttaaggacccgccacaggatcacccagaggtatgttccaagataaactaagaagaaccttcaaaaaagaggccccaggctggtgaaaccttgtgacaaagacatttaacccaacctggggcccgagacaggcctctctggagatgctgggcctgggctgcaatctggagagtggaagacagcaactagatgaaatggagcagggaagaacgttccagacagggtgtctggcatgggcacagtccagcagaggaagtccagaatggctggagctctgagtgaagaggtagcctgagatccagcagggaggccatagggccccagcgatacaggactctggcttgggcatttgatctttatcctaaaagcactgcaaagccactgtagagttttcagcaagggaactgtgtacatagggaataccactggctgcagtatgaggaaagggttggaaggaaccagtgaaagcggggcctgccgagaggctcctccatagtccaggtgatggtggcggagaccagcactgtgccagcgggcagtcaaggaaggagtgttgagaagggatgtgttgaggatggaatctcccggggcagggctaggacaggggtgggggacaagctggggacggagtggagggagaggaaggagtcaaggtaaccccctccaggcttctggtttgtgcaatgagatgggggttaaccaccaagctgggggcagtgtgggaggaggggaaaaggctgagctgcagatgcttctgagagactggcgtccattggagctagagaccaggggtgagggggtaaggagacgccacctgggtcgtgtggtgagtgcaggcctgaagcagctactcggagccacaccttctctgtagctcctttagcacgacgggtgccgctgctcccactttccagaagaggaaactaaggctcagactggaaaactgcttacatagagttccacagtggcagaaccaagatctgccctccctgagtttttctcacttcaagctgcctcaggatgcctctctggctcgaacctggcccagaggagaaagcagagccacccacatacacagctgggactacagggagctttaagcatctgacaggcccttggtgggaagcttcccctgcagaggagaaaagggctaggaaggcagcctggagatgagcaagggccccacctccccatggtcagggccactaatctcacgctccttctgtgcattatacaaacttactctgctgggcccttcacacccaagaaggagtgctgttgctattcagtcgctcagcctgaactgataccccatggactgcagtatgccaggcttccctgcccctcactatctcccagagtttgctgaagttcatgtccattgcattggtgatgctatccaaccatctcatcctctgccaccctcttcttttgcctccaatctttcccagcatcaaggtcctttccaatgagttgggcttcacatcacgtggccaaagtattgctgctgctcccattttacagctggggaaagagaggcccagagagaggacagtcaaggtgagtttgtggcaaaatacagaaagccagggatgtctggtgccaggttcccagctcactctctccaaggactggaggggtttagtgagcagctaggggaggcagagagtgagaagccctgggcttaagggctacccagtccctcctatcccccatcaacccctcagtgggcctgggcctctggggtgcagacccgaggggatggggagaaggatggtattgagtctgccaggaagcttctgagagcctttgtggctacctgagcatccccactagcatctcttcactcttccacctgccctcacctccagagccaggcagcctcttgagcccaagcaggggaagggagaaggctgacagaggtctttccctgcccgcatcgtgcctgtctattcagttatcctcctgtcggggcctttgggggcagtcccgttggtgctggaccctctggtccctttgttcagaagagacctgaacaaaggggaccgagaccaagaagcagcagccagctcaggtggggagggaacaggaatcctgtggcccacaggagggtgactgctggcccagcctggagaaaccacacgctggagaaggccaaccctgtcctgtgaaccttgggatttgcaggtgtgatgggaagacccaactgcacagaagcagttgcttccctgcagaccccaagggatagcaaggagagggcagagcttagagggtcaaatatgtgtgtggggatgccgaggacaaggacgaagcagaaggggtcctggccagcagggggcgccagcgcaacagaaatccaagcaggtggtttgcaaggagcctgaaggccttgtctcaagtccggaggttaccagggctagagcatgatgctagagcacggaatgaagaggcacccactgatcagacctggctgttgaagcacgaccccagcacagggggcccggtatggtgtcataaataagagcccagccttcagaatctgcaaggacagatgagttggaatcctggttgctgctgtgcggccttaggcaagtcttttcctctctgatcttcagtccacctccataacaggaagatgctcattgcacttccagcctggggtcctggcgtgcagtaagtccccagtaaatggacaaagtgcttcataaaaaacaaagaatgcgttcagacgtcaggactggcaggaggatgcccacacccgccctccccccacccccagccactgacccagggtcctttaccttcccatacaggttggggtgggtacccacttccttcagagccagagggggttcagtgcaggaagaaggggcctcagggacagaatgccaggcaacgcaccagggatggagctgggaccttggccacttgacaggtttgcttcatttgctcaacaaagttatcaagcattcatcaagcacctgccccctggcaggctctgtaccaggcacagaagtatcaggtgagaaggcacacagacccaggcagtgacacctcctgctggccccaggcgggtggggccgggttctgcccctcctggcttgcgctagttggacacatcctggggccacttgagccacaaggccccgctactgcccaggtaagatgacctgtgactcagcagtcaaaggctcttgaaggctggaggtcagggagtgggctggcggcagaggtgggcatctcccactcttgtgctctcttccctgcaaaggccgctgcttgcagagactctggagctgacaaggcttggttcacatccaggctttctacataattcccagggcccctgagggagtcaatttctaccctctcagccccagatgccgctaggagaatacaggaaacactttaaatgatttactatatgatttctctttctctttcataaagaaagctcctctgctacaaactaaccctgtgaggttggtattggtacccagctatagcaaaggaaaggctcagagaagttaagtgacttgcacaagatcacacagtatatatcaggcccatcaaactccaaagcctatattccttctagagcacatactagctcagggcagattgattgttccttcttgataatgggctcatctgagaccaaaagaatcctcagttcgcagaaagctgtcagtgatgaagggcccttctggggtcctgacccccaccatcagaagcctaaggtcttggttgataaccctggcactgttgcagactggatgacctcaggccaggtcaaggtccaaagctcataccaagccccaggctcccgctcctgaaatgcaggggaggagttaagcattggacacagcattcctggcctttctctgcttctcacctccacctgctccatcacacagactgacccccaggcttccctctccagggaatccatgagactagcccacacaaacatggcaagaagctgctctgctgaaaggtgctgcaacttctcagaagcatagtgcctgcccggggctgaggctgcaggagctcagctgagatgccttcctgatgtatcttgagtttcccctgaggatttcctgcaggtcctcgaagcagaccttccagctgaggaagctctgcatctgggaacacaagagaccctgcgtctgtctgggcagagagacgcagtgggctgaagtcttccctagcctgttctgggcttatgtcttggtcgctggcactgctggattctcctggccacaaaggaggtgagaggctcagctgaaattgtaagggactcccagacctgagatgctccaattgtaattaaattccctgatcaagccatcagataaactggattgccttcacaagagcacagaatcagccagctataatgccagacccacagctcctcttccccagcctgcaggatgatccagcagggggaaggtactgtcattaaaaaggactttggggagagaacaaggaagaatcagatgtggaagagaactgctaggacgccccacagccaagcctgaggtcagacggcaagtgcccgggaaggaattcctggcaagcctgcgtcctcatgtttcaccaagacgtccaatgtgcctcagagaaggacaacatcagtggctaaacatctcttttccaggtgggatctggcagctggaaaacctgtgctgtagccagagtggtaccctgggttcttgtttgcatccggagcagttttagttgcataaaaaggaaggtgtgtgtgtatgtgtgcgtgcgtgtatgagggtgtatttccccctcagtataacattattgctggttaacaggataaattgggaaaatgcaactacaaagcgaaaccacacagccctgtctcccccaacactttcagccttctagtgacttctgtttgtcctcgggctttagaacactctctgctgtctccctcagcacagttaagattttaaagtgagcattttcctctcactctgagcccttcctctgcccaaaggctgctccctggttcacagtcttaaggtcgtttccatcttctgctattctggatacgcctaccacaggtgcctgcatgtgtgggaagcttttcccacgttctgaactatcccctttggatgaaggctctccatctgaagatcctctttgcaggttgattcttggagcctgtgagagctggagaccatgcctcccaacctgggagccctccacgttctttgtccccaaaatggccagagggcatacctgcgagaatttcccttctgctcaaggcccacagggatgcgggtgtcaccccagtggccctgaaaaggggactgaggctcctgaggagacaggttctcgtttgcttcatgtatgaaaaagcagcccatcagctggagatttctctttggggttcacggtcagacgcatgggggtcttgtctctgtcactggctagctgtgtgactttgggcaagttacttcccctctctgagcctgtattctcatctggagagtggagatgataatggcacctacttttctcgagtggctgtacacatgaagtgcaatgatgcaggtaaggccttcagcccagagttggctacagcactgtaagtggttaacacattggaaccattgttgttactcagccgctaagtcgtctctgactctttgtgaccccatgaactgttggttggaaccacagatggctactttagctgcatagccctttcagtccaaaaggtgtcctctgacttctccgggtgttcatttctccagggctaaatgggactgaggatgatttctgcctcccagagttgccagggagcaaatgagcccactgggataagaaggaactccttgtcaactgcagagcgcatggtggtcatttactttgcttgttgttggaatcttctggtgggaactcactacctatggatggggccccaggggcagatctggctaatacagcctcctccaggaagacaaagcctgtctctagctcttcacaagctggctccaacttccacagaaaccccccatcccaacccccgggatctgggttcacacagcgctgaggtccagccctggatgcatcactcccatctgtatgtccacgcccactggcccttctgtccctcaggcttctctctgtaaagtggtggctccccttctgccttcttgttagacagagcaggtgagctcacagtgcaccccgtgggtgctcattcttcatacatttccttttccccgaagatccacaggccagagggccccttctcccagctgcctgggtacatctagaatcaccttcctggtgctctgcccgccatgcctgatgtgaccagagtgggggccaggctggtctgtgaaggtcagaggtgtggatgggctcggggtccacagagagggggagagcaaatgagacccagacatgccagcttgtccaggccctcccccaggtgaaggtgtagcctgggatgagagagctcttaggggggcggcaggaggcgggatacacagccctgccctgtaccagagctctcacagtggagagctgtggagtgtgtgagtgtgtgtgtgtgtgtgtgtgtgtgtgtgtgtgagtgtatgtgcacccagttcagtcgctcagtcgtgagcgctctgactctttgtgatcccatggactgcagcacgccaggccgtcctgtccatcaccaattcccggagttcactcaaactcatgtccattgagtcggtgatgccatccaaccatcttattctctgtcgtccccttctcctcccgccttcaatctttcaagcatcagggttttttccagtgagtcacccacctgcaattataaaaccagatgcagtcaggaatgtttcaggagtgctggggggctgtggcagaggtgtgggcagttgcccctggggttagggtgtggaggcagaggtgggcttctggaggagggcatacctatctatgggagccggtgtcttccagggccctgagaagcccctcccgacactccccttggtggtggctgcacagctcccgcccagaagccagaaactgaccggaagggcttaaggcagtctagactccctcccaaggagcccgacctggcctgctcctacctcctgaccctacccccatcaccttaccagagcctgggggccctgggagtgtggtcagggagctctccccacacccaatggccagggaccacgggggagaccggaggcaagacccaagaaggcaggcatgggtgaaagtcaggaagcccaggacccaggctggtcttcgtgggcgcctcctgcagacctggcagcctctatgcctgaaacctcacagcaccttccaagggcggtgttgtcatgacccccatcttacagaggaagaaactgaggcccgcagaagtgacagaaccattctcccaagccagcgctgagccttgagccccatctgtgacagagtgtggcacacagagcccctcaccatgacgctgctgtgggccagcttgcgagtcagtgtgcccacccctccccccgaccctgtaaggcaggcggcttcagctcccactaaacaaacaggaacaagaccccccaggggcactgccctctcggagtggagctggctgtggcaagtgaggactcagggcttttattgccatttcagacacacaggaaggtcaaagcagacagaggggatggccgcagaggggcctggggtctccccactgggatgcctcagctttgaccccacccataaggacagccatgtgcccttctcaaccaggagggcaggtgtgggaggcctccaggacatgagatgggtcagcagacaccacctggcctgatgagcaggtccacccagggtgacctcggcctggcagtcacagcccagtgccaagaggaaggcctgggctcgctggcatttccagaactgccaggcaccagggtgggggcctagggttggtacccatcacagctctcagctaatggctgagatgtcaatccaccctccaaagtcggtccaaaataacttaattagcttgaaagagctgctggcagcctgccaggatggggtgggggaagggtagcaggacgagggccccccaacactgcagggaagaaccttgacaggaagacaagagcacccccattctgtggactgtaccctttcctcatcacagggactcgacccaccatggctctgccaggtccagccaactgagcccactggacagatgaggaaactgaggctcagagggggccaggatgcgctctgctgtattcatggcagatgggcactttgaaagtggggtgatgctacttgggggcaggaaaagttcagccctagaaaagctggtggggtctctagggagagagattaaggtgccagcaacgtaccatcaagccagagggatcccaggttgacatcggaagggacttgaggctgcaggaaaggacctgagcctaatctggaagaaaagagtgtgtggcatgaggcagtatccaccttgagagtcccagcgctgggggtccttgcccctctggcagagggttttagccagagccaagtctctgatagggtggcacctaggatcccctgctccctgcagcccccaggacactgggagcccaggcatggcggtgatcgggtgcgatcagggtgagacagacacacagccactgccctccagaccctgatgctgccctgtcagtgccaggctgggcactgccccaggatcacaggcaagggatggctgtgtgtgtggcagcccagagaggaacatgggacgcccagtgagctggagctctgccccaggtgtctgctccaaggctgagctcactactggtcccactggacacttgctcctcccacctcagagaatacactccgtcaaccacccaggttcccaagtcagacactggctgtctccctcctgctcaccccacccccagtcctgcccaagtcacctcccgaacttttgtaatctatctatcctgcaccctgtcccccatcccacccaatccagaccaccactgtccctctggatcgctgccaagtccttgtcacccatttctctggtctgcacactattctctctgtctctctctcacatgcatgtgccccatgaattatcaagggaatctttccaaaactcaagttcaaccaggtcagcctcattgccctccccaacctggccttggagactggggggattttcccactcacctcactgaggttggaacagagcaactgaaaccctgggctccagatcagccaggtctgggtctgcatcctgggtgggccgtttggtgactgtgtgatcttggatgagtcacaccaccttcctgagctctttcctcacctaggaagcaaggctgccacgaccttcatcaagaagaccccatggggcaccagggtggggccatgctgagcgcccggctcagagcagccacaccacgtggcaccaacgggcaccggccagctcccggctgcctctcaacacccgcctcacgtgctgcaggctgtgacctgacccggcagctggtcctccctctggctccaagagccccgtaacaccttgctctccacctatcggttctctggcctgtctctacctgtgagcaggagtagagcctgggacaggctcgatttacatttgatgaatgaatgaatgcagtacgagtgtctacagagggacacggccacgtagagaggcgcacaacacacacagccacctgcggctcagacgggctgagggccagagggggcccctaggttggtccattattacacacccctcggtgcagcccagctcagcttgagcctaagaagaaagctcaggacctgttttctgagggtccacgagggtgtgtgccctgcctccatcacgaggcatctgagcctaccacactcgggactacaaggagcagcccagggggccacagcacccccctgggcagggctgcctaaagtgggggtgcggggtggagtggtggctgccagctggcgagcgcctgggcctggcagtgccgccgatcgcccactcgcaccagctgttagtttccatggcctgcccaccagctagccaggatgctgggcccgggctgccctggggtgtcctgccaggaagaggcagcctctaggagggtggcctgggcagaggggagggcagaggaggggcaggggaggatgaggatgccaggctggaggaggccagggccaccctccgctcacagtgtggcccggaacaggctgccgcacttccagcgcctcaggcgcctcttctgggcagtccatgaggggccggaggtggggatggtgcccagggctcctccctccgctcaaaacacccagcaacagggattctggaccctcgggaggggaggtgctccgaggtctgcgaccacaagagggcgcccgagcctcaccttgcagggagccaaggcctgaggcccgcggtggagctgtgcctgggagagggcctgggagctgggactgaatccctgggcgtggcatgcagctacctgcgtccattctcaggcaagaccccatccacactttagctcttttttcaactgatggcaacactacctgcttcagtatacgtctgcagagtaagcgcaggaacacgctgctgctaagtcgcttcagtcgtgtccgattctgtgcaaccccatagacgacagcccaccaggctcccccgtccctgggattctccaggcaagaatactggagtgggttgccatttccttctccaatgaatgaaagtgaaaagtgaaagtgaagttgctcagtcgtgtctgactcctagcgaccccatggactgcagcctaccaggctcctccgtccatgggattttccaggcaagagtactggagtggggtgccatttccttctccaggaacacactaattgaatgataacggtgatgtagtattttaccgatgaagagaatggactcagagaggtttagtgatttgcctaagtcacacagcagtaggcatggagcaagttattccctctggtgctgggtgctggcagagctttggaaagagtcctggcaccaactcacagggggttagcagcactcaagtcctcagggtagggaccaagcctgattctggctcccccaggtcaccctgtgccataaagaccagacccttttctgggcaattacattaatgaaaagaggtcccagctgtgagccctttacacacccatgaggcatcctcgtcctctgactcacagatgaaggaggaaggcatgagagaagttaagaacttgccagaggccacaaagcttagttccagtactttggccccagaatccaccctcccctcaccatgctatgtcctggggaaactgtttttcccaaaggagcttctggccacctccgtccctctcctgttcacccaacagctttcccacctattcagttggggcagaggtgaacaccaggcccggccccatggaccgaccaccacccaaggggagacagacaaggtgcacatgactcattcagggccggagggcccctaaccaatcaggggtgtcagggtcttctgtggggaggcaaccactgagctgagttgcaaggaaaaaatgtagcacaatggcccttgctggcctcccattctgggcccagggggagctcgtgagttgggagaaactggccctgtgtgggtaggaggagtgggcaccccaagggcgagtccaggctggttcccagcaccctccagcacctggtcatcacaaagtcatggtgggctcatcaaggaatcaccactgggttgtgattggttatgggtgttcatggagccaagccctccaccagccttcccgcctttctctcaggatgggtaccccctagggcttcctcgattctatggggaccagagttggcggggtcaccaccctctgggtacaccgggcacagaccattgggccaccaacgcagcacctggagcccagagctcagagtctgagcagagcctggctggagggattgggggcaccagccagggtcccagcctgctgccttttgcatcaccagcctggagcccagcccagggccggcacctgtgcctcaaggcaccttgaggacctaactgcgcccctctgagaccctcttcccctaatggggcagtgaaagcacagccagccccagtgctccctgaccctcctggtctctcagggcctcctgtgtggttctagaagcaggactcaggctgtggcagccacctctctccaccagtggccaccgacactgaggtgcagagggagcctgggggctgtgaaggaggctgctccccctcatcgtgccagcagtggtgagaatcagacttccccgttcaaggacccccagctgatgttctttgtacccctgtgcccagccaccccctgcccctcagttctggggtccgtcagcaccaacagccctctcctcctctgcactctcccagccatccccaccccggacattgcctgcccccagaaccgccccctgatatttcccccctcccacccaggactggcttctctgtccaccatcctccaccctccctgttgggctggcttcactctcctgaccccgctctctgacctcatctcacccccctttcctcctcctggactccctccttatccagcctatatcccaagggacctttctgcacccagagtctcgagcacaccgaccctcaaaaatctcccaccccattctgcaaatgcccagcctggggcagacccacagtgctcctcctagaggatcccatctgtccccaggccccagggtccccctcccttgtctctccccacttcttccttccatcaagaaacacactcacctcttgataatgatctttcaagctgctctcttagccctgcacatggctccaactgggccccattccttctccccagcctggtggagctcttcaagcgttacttgtgtgcccatctctgcctcctcagccccctgccctctgcaccgcagtccaccaaaactcttctcatccgtcactcctgctacatcccgagagagttgggttcccatcccaggctggggccagagagctgtgccctgctctccccctcttccctgccccctgctcgtctccatggccccacgccctagtgaaggtcccctggctgctccttactcccccagtaggtccttctgccatcctgtcccacagacgacggagctctcttctagccccacatgatcatcccataccactgccccctcttacccggtaccaatgttcccaaactcgccaaggcctgtctccacgcccagggatccaactgcgtcttcagtgtgggtcaactccatccaagtaacttaatcgtgacacagtaacttcatgaaggaagtactattattatccccaatttgcagatgggggcaccaaggcacagagagagttgcccagggtaaacagctgatcagcctctgaaccaaggtctccttcctggagatccctcaagagcctcagattcaccataaacagaacaagctcacgggctctgcactgaatgtcttcttcctggccaagctggcctttggactggacagtgacaagcgtctggaccgtgggcaattttactttctgtgggaagtacttaacccagagctcaacagcagtaagtggccagtacaggccagctgctgttgtcaccatggccctccaaacctcagctgcttctagaagatggggctattgggggaatgtctgagctcagggcctggccacacgggggagactatagccctggccactccgcacaagagcctttttgcagtaagtcaaagcagcatcaatttataatgctgcaagtttggcacaaatgcactatttttcttaagccaaaataaagctccaataagctgtaaaagccctggagttgggaggattctctgcggggtcatttagggtgagttagaacctgcagctgtgaactcctcagccacacatggcaacctgggtgggtacaccccagaatgctaatgaaggcagctgctcagggtcggggagccagctttgctctggcttcaggccccagggagagggaaagccatgtggggtgagacaggacaggacctcagccaccctgggctgcgtgatctgggccaagcccgggccccactccaagctgcagcttcttccgatggggttccgaagcatgactcagaagagggaagttcagggcctggggtggggacttcgaatgatgtgtgcaggcattttcattccttgggcagagatctcaggatttgtaatagtgttgtaggaaaaatgggattaaacatgccaatatttgcttatgtacacaaccgtttccataaagcaggattgtgccccatctcaatggaagcaaccccaaagtccttcttgtttggggcaggtgagcatatgggaggctggatttgatcccaaactctgccctttgccaatcatggtctccccaagggacggttccccttgcccgttccacaggtgaggagactaaggcctgactctaaaatgcagcatcttaacttgtgtatatgcatgtgacccagctcccagtctctctgacctctggcttggtgaggtcacctctgcccgaggccctgcaccctcccccaattccctggtgcctggcaaagaacccagatcttgaaactccagagctcagctctgcacatacaagttcacgatcagaaacaagtaggtaccctctctctgggcctccgtttcctcctctgagccttggtaaaatgagggtgatgatggtagctaccccaaacagttaagctaattcatgcaaaacacccttgtggtgcctggcacaggataagtgctcaaccagcattcaatccgttcaggagataggatctatgacttctactctgaagataagtaaacagagaattggagaggtttggccacttgtccaaggtcacagagctcaggagctgtgatggcagggggagggtgtgaggggggcacgagctgaggctcaaaccaggtctccttgtccccatcagggtccagatggaaggggagtcaccgagccaaagcccccagggcagggacagggagagaagggaaggaggagagaaacaggaaggctaccaggacagagacgggaccgggagcaagctactgcctggggcagagggcccaagcccgcaggggtcacggggcacggttccccgggctgacagtgggcactctcaccttcaccctgttctctggtggctggtgaccttgacaactcaacctgcatcactcacatcctagtaaggccctgaaggcagacgttttgggggtggctcatctacatgacagcctcccacaccttgagccagagccagggtcctgccccctcccctggagttcaggagcaccctgcccacccaggggctcccattctgggctgcaggggcaggaggtgagccggagccctgagaaaccaacagcctacctacctgaggtgacctccaaccaacctcaagacctagggcacctagagggtggggggagcctccacctacagcagccagcctccatgtgcccacccgcaggcctcgcccatctctgctgacagctgggaattcctgccgtgtgacccagtcagcctttcagggctgggatcctggcccagccacccagacacggttatagctcaggctgtgagctgcctatgaggccagggcaagtgattcccatctctgggacttggcttctccaggtcagaggagggatgagctgcgagctgaaacaactcttcccacccagaggatctcgggatctggaatcccagaagccaagtgttggagagaacttcgggctgcgatttcctaacactggcctgcagcctgacaaagtcagggtccccggggagtcctgtgaacatgtacacgcgggggctcccttccacccccagcagatcagcagatgcggagccgggtgttctgcagatttagctagtgccctgggtccatgccttctgctgactctcaggggtgggggcaggggaaggaaggggagggtggggctgagggttcttcccgagacaaggtgcccagggatccctgagcctcccaaaatctttactgcttcatcccttgagtgtcctcagaccccctcccgcccgccacccagggctggaatccagcctttgctcccatcagcaactcctccacagaattctccaccagcttctccccatcctggtcctcttcacccaggagaggccacagctactggcccttccagcttcccctcccactcaaatcaggggcctgctttttgttttcttcctctcaagcctgcataaagaacactggatttagatgaacagctctgtgcacaggccctgtctgggccccatgtaactgccaccctgttgagctctaacacatttcctccaccccaaagagcccccagtcaagccccctgctcactgcacctccccggcccccctcagcagacctctagccccacagattagaagggagaagcctctttctaagcagctcttctgtgctcatcaggttggactgaaacccctgaggacagcaactgggctgtcctgctggctggcagtgcctggcacagagcagacattcgggaagggctgtgagaggaaggacaaggtggctgcaggctgcacccctgctccagctgctgccgtgatgagtctccttggctcatcatcccagcttccttcaatgtctaccacactctcagcccccagccccctgcaggacgcctggcacatggacacgcaggtgcaacacccccacctgccccggccaggcctctgtcaatgctcagacacctctttccccacagggctcctgccccatccccaagccttggctcccagaatcctggaatcacaggcacaccgaattcctggatctgcactctccccagtgcctccagcccctacccactctggcctcacttgtcctggcaggctgtcttctgtccctgtcccagcaccgtctcagcccccacagcaactcagagcctccgcactaagctattagcaggaagtcagctctccctcatgcccacaggctcccgcatgtgacctgcgacgagcaccctcccctctccaagcctcagctcctccgtctgtaagacagccccatcaggctatgtggattcagtggactcttctggctctgatgtttcctgcagatcactgcccacggttagtgtaaataaacatttattagataaataactagccccaaagaatgagtcatcattgatggtggaacggtagacatcagctgcaggccacttagaggcagaattcaagagtggtggtgaaagctggattcagactgcctgggttggaaaccctggttcacgacttcctcatctgtaagatggagatcacagtagggcagggtgaggatgaagtgcgatagtgtacagaagcagccagaagagcacctggcacttaaccagcgctcaggagaacttagctcccactggtacccccagcgccactgtccctcagcaaggctcgggagtccacatcagcgacctgcgggtggagccaagcgtagcagcagtgcctgactagtgccaccagagggcaccatgacgcagccaaagccgcccagctgaaccgagggctccctgattcatcctgagtggcagtgccagccagaagcctcccagctgggaggacgagggtggggcctggatgcccgaggagttctttctgcaggagatgcccgcaccaccttggcttgatattctgcccattcctagcacagtctgtgaccaacagcaacccaaagtgtccctaatccttccctccagagccatcagacccatttaacagatgaggaaacaggcctgagagaggccagctccaggtcatgaggtgaactctggccttcctgctcagactgacctcccagtacaccccactaaacactatgggtgtggcgcccacccccacaaccaaagctgggagccagcacctgtgcccacctgacactccttgggcagaggagagacaccagggaaaaaagcacatctaatggtggggagacctcaaggacggagggcccggggaaagtgctggatgtgagaggaagagacaaagaaacacgaggcgaaacagggtggggtgggcacggaagacaggagatgcaggagagacattcgagaaagtgaatgggtggaaagagacagacaggggaagaggcacagagacagagaatcccgagggagaaggcaaagagagaagcagaggcagaaggacggagacagaggcagagggagcgattgaggaaaagagagatggggatggggtcatggtgacagagagagacgggaggcagacccagggacaaagacctgtgggcaggggaccctggagggccaccgaagcggcttcactctggtctggagcccccatgccctcctcccaggcactcagccagagctctcgcccttgcatttctgtcacaccccctaccccagcagggcttgccagacagacaccccctcttgggggtggtggttgagccgggttccctagggcatctaaggcagacaggtagggtccctggggccgtgttgctaggagatccagcccagggccccagcctatctcctgagcctctcctagggcaaggctcaacactcacctaggggctcacctgagacctggattccccctagctttcaccccgtctggccctggacagcctctgccctgcatcctcttggcagagggaaggcacacctggtgacccagccggttgccaggcctccctggctcctgccccaggccccggggcctgctgtgttccttagaagcactagattcccgggcttgggtgcaggtggcagggagattgttcaaatctcagcctgccttttaccagctgtgtgcccctgggcaagtcactctccccctctgagtcttatctttaaacaaaaataataacagtatccattccatagggtcctctagaggaggaagagccataatgagggcacagcaactgggatgggagactggttttaagctccatctctgagccacctgggctgcagctgggagcatctccccgcagtccctgtctcccctttgcacctccttgagcaggctagagtctgattcacagcagcctcaggggaaggggctgcccagagccctcccagggaactcagataccaggagacatgaacactaggggcccaggcaaaaccacacccacatggttgttcgggcctgtgtgctgctttggggccttagatgaaagcaacttcagggcttcccaggtggcgctggtggtaaagaacctgcctgccaatgcaggagacataagagacatgagtttgatccctgggttgggaagatcccctggaggagggcatggcaacccactcaagtattcttgcctggagaataccatggacagagaagcctggcaggctacggtccatagggtcacaaagagtcggacatgactgaagcaccttagcagnnnnnnnnnnnnnnnnnnnnnnnnnnnnnnnnnnnnnnnnnnnnnnnnnncagctttctcacttgcactgctgctgctgctcctgctaagtcgcttcagtcgtgtccgactctgtgcgaccccatagaccacagcccaccaggctcccccgtccctgggattctccaggcaagaacactggcgtaggttgccatttccttctccaatgcatgaaactgaaagtgaagtcgctcagttgtgtccgactcttagcgaccccatggactgcagcctaccaggctcctccatccatgggattttctaggcaaaagtactggattgggttgctattgccttctcctcacctgcactgcaggggagttgaaaaggatgatctctgtctgtctagcttccaaggaggcctccgactgttacctccggtattcacacccctgtgtaatcactgaagagactgaatcagtgtaacagatggagcggcgtgaacgtgagagtagggctcccgaagcacaggacagggaggctacgctgctcctctgatcacaggctctggggaccccagtcgccatgtggtaaggatactcaagcagcccagtggagaggaacggaggcttcccaccaacaaacagtaccaaccagccaggtgagggggttagtcaccttagaagcagatcctttatccccaggcaaatctgcagatgaccccagcccctgaccccagccccagccaagatcttggctacatgagagaccctgagccagaaccactcagctaagccaatcccaagactcctgatccctagaagctctgtgagataataaatgctgattgttcaaagccacaaagttttaaggttactggctacacaaaataaagtaatgaatatatttccaccttctgctgcctacccccagagttctggtctgaatcattggtctttcagaaaagccctaggttggtgtcaccaatgtcaaactcaactaagttcagggaggagctcatcatatccccccccatctacttccacaattagccattgccaacggacgtcctctagaatcaaagacagatacgtggtgtgcattattgttcagtcgctaagtcatgttcaactctgcagctccataaactgcagcgtgccacggttccctgtccttcaccatctcccagagcttgttcaaactcatgtgcattgagtcagtaatgccatccaaccatctcatcctctgtcacccccttctcctcctgccctcaatctttcccagcattaaggtattttctaatgaatcagctcttcgcttcaggtggccaaaggattggagcttcagcttcagcatcagtccttccaataaatattcagggttgattttctttaggattgactggtttgatctccttgcagtccaagggactctcaagagtcttctccagcaccacagttcgaaagcatcaattctttgctgttcagccctctctgtggtccaattatcacaaccatacatgactactggaaaaatcatagctttgactagacagacctttgtggtgtgcattattgccttccttatcccagcattcagccactgacaaacttggcctcttttatctcctgcccatctctagaatcctccctctctttaccaagcctaggtgccctgccccagctcaggccacaccctctcttgccagttcagcggctcctctctagtctccctgcctccatccttgctgctcttaccacccatccatcctccacactggccgctagagggagggacttcctaaaacatagatctgatcatgatgctcacctgctcattaatcttccatggctcccctgttgcctaaggcccgaactccttggcctggctttgaaggccttttttcatctgcccctaccccttacctctccatcctcatctctagtttttctttgtctcagtgttccattgatactgagccacctgcaattcttggaacacaagagtttcatacttccacacctttgctcacacagttctctccacctggattcccctccccttctttacctggaaaattcctactaatctgtcaagccctagccgtctgattctccgtgaggagctggtctctcactgcatcttattggactacaacaaactgtttacatgtctattcacccacaaagtgacaacctccaaagcaggatgtctttttcatctctatattcctagtaccttgctcagtcccagcatacagaattccataaagttcttaaaatggaagacctttagattgaactttaaggtcaactcatttaaaaatcattttggatgggaacacctctaaaaggtattacagactctcctacctttttaaactagtttatgggacatgattgaaccttgctcgagtgtatggtttatgtcagtacaaaccccgggtttttcagaaggagccttggaggtcatccaatagaggaaggacctcaggtctggaaagatcacgtgacttgcccaaggactttgcatgacgaacgttaatgaacatctgagctgcaagacggtgatctctttgctttgatgaaggatgtcaagcccttgccttgccacggcactaaatggcccctttagtcaatgtctttaaggtttctgtatgttttagaatcatcccatttcagcactaggccagtgtacctggcccccactttacccctctagtttgttacttctggtccactggaggcaggaggatcaggtaaccaaacttgatggaatcacacggaaaggaagagttacagccctggcctgagacctgggagcactgctcctcgggggagtgtggcgggacgatgggactttgtggccctcctgcctctgctgtgccccagatatgacagttgtcgtgaggagagactgaaggcttgggctggttctggcggagggaagtgtcagcataaccaagagatcctgcaggcaattcactcccaggtagatgactccacagggaggacaaagaggcggatcctggaccctgggctccataagctcccttcccacactccctcatcagagacaaagtgcatagtgcaagaggcaaaaggaagcagggcctctggggtggggtggggagagggggnnnnnnnnnnnnnnnnnnnnnnnnnnnnnnnnnnnnnnnnnnnnnnnnnnactggataggtgggaatagctctgtttatcttatccagcgagcaaacgaatgagggtggaacaggaagcaatgaactaagagatgaggattctagtccagcttccactactaactggatgcatgtcaaggggcaactcaactagtcaatctaggtgtccgtttcagaatctgtgaagtggggatgtgtgtgaaagttttagtcgtttagtcatgtccgactctatgccactccatggactgcagcctgccagactcctccgtctatggaattctccaggcaagaatactagaggcggtagccattcccttctccagggatcttcccgacccatggatcatacccacatctcccacattgcaggcagattctttaagatctgagccactagggaagccctgaaatggggataattcctacatcatggggttatagtgggattaacaaaaataatgtaaaaaagaacttagttctaaagtgctgctcaagggaacatggccttcattcacgcattgcacaaacacttactgattacctactatatgccagctgttccaggaactggggctgtggccatgaacatgacaaagcccaggtcccatggagctgactttctggggcgggagacacataaatgaataataatgtactaatcagtatctcaataaaggacagaaacggtatggacctagtagaagcagaagatattaagaagcggtggcaagaatacacagaagaactgtacaaaaaagatcttcatgacccagataatcacgatggtgtgatcactcacctagagccagacatcctggaatgtgaagtcaagtgggccttagaaagcatcatgacgaacaaagctagtggaggtgatggaattccagttgagttatttcaaatcctgaaagatgatgctgtgaaagtgctgcactcagtatgccagaaaatttggaaaactcagcagtggccacaggactggaaaaggtcagttttcattccaatcccaaagaaaggcaatgccaaagaatgctcaaactaccgcacaattgcactcatctcacatgctagtaaagtaatgctcaaaattctccaagccaggcttcagcaatacgtgaaccgtgaacttcctgatgttcaagctggttttagaagaggcagaggaaccagagatcaaattgccaacatctgctggatcatggaaaaagcaagagagttccagaaaaacatctatttctgctttattgactatgccaaagcctttgactatgtggatcacaaaaaactgtggaaaattctgaaagagatgggaataccagaccacctgatctgcctcgtgagaaacctgtatgcaggtcaggaagcaacagttagaactggacatggaacaatagactggttccaaataggaaaaggattacgtcaaggctgtatattatcaccctgcttatttaacttctatgcagagtacatcatgagaaacgttggactggaagaaacacaagctggactcaagattgccgggagaaatatcaataacctcagatatgcagatgacaccacccttatggcagaaagtgaagaggaactaaaaagcctcttgatgaaagtgaaagaggagagtgaaaaagttggcttaaagctcaacattcagaaaacgaagatcatggcatccggtcccaccacttcatgggaaatagatggggaaacagtggaaacagtgtcagactttattttggggggctccaaagtcactgcagatggtgactgtagccatgaaattaaaagatgcttactccttggaaggaaagttatgaccaacctagatagcacattcaaaaacagagacattactttgccaacaaaggtctgtctagtcaaggctatggtttgtcctgtggtcatgtatggatgtgagagttggactgtgaagaaggctgagcaccgaagaattgatgcttttgaagtgtggtgttggagaagactcttgagagtcccttggactgcaaggagatccaaccagtccattgtgaaggagatcagccctgggatttctttggagggaatgatgctgaagctgaaactccagtactttggccacctcatgtgaagagttgactcagtggaaaagactctgatgctgggagggatagggggcaggaggagaaggggacgacagaggatgagatggctggatggaatcactgactcgatggacgtgagtctgggtgaactccgggcgttggtgatggacagggaggcctggcgtgctgcaattcatggggttgcaaagagtcagacacgactgagcgactgaactgaactgaagcagtatctcagtcagaatgggcacaactatgttgccatcaatgattcttaaagccactaagagtcattttcactcacactgtatgttcttggagaaaatgcctgtaaaccatttcaagctgcccccatctagggacccaggctgaaggaggctccatcccgaacttccacaaaagggcacatggcaagtagcaccaaagtccaaaagccccgaccctagccctgaaagtacacagatcacgactatcccatttcacttcccgccagctagtaacgtggttatgttcatcttctgcaagaggtgggggaatgcagccctgctgtgtacccagaagatgtatgtaggtgcagtgtatttggtagacagcactaatgcccattatggatagagtcttggctaagtaccacgaaaacaaatagtgtaaagagatgtgaggttggggatgagggagtctgggaaaggcctcccgaggaggtcacgttcaaacaaatatgtaaacaaaatctggagcaatcccagaggaagagcacaggaacgcaagggaggagtgagtgtcctaggacaggtggagagcaaggagcccagtgggctggggcaaggagccaggggcagtgttgtaaagagagaggcattcagggaaggaagcagaccacacggccactaagtcagccagggcttggtctttcctcggtgagatgggatgttgttacagggggctgcagatgagcagaacctttagtagataaaagacaaacagtccctggtgccagaatgcctgcggccaaagcccagctccatcccccactagcacaagaccatgggcaagttacttgatctctctgaagctcagcttcctctccataatcagataagatcagatcagatcagtcgctcagtcctgtccaactctttgtgaccccatgaatcgcagcacgccaggcctccctgtccatcaccaactcccggagttcactcagactcacgtccatcgagtcagtgatgccatccagccatctcatcctctgtcattctcttctcctcctgcccccaatccctcccagcatcagagtcttttccactgagtcaactcttcgcatgaggtggccaaagtactggagtttcagtttcagcatcattccttccaaagaaatcccagggctgatctcctttagagatcagaatggaccttagaatggactggttggatctccttgcagtccaagggactctcaagagtcttctccaacaccacagttcaaaagcataatagttgaggttaatacaaagacctacctcccagggttattgtgatggtaaaatgcttaaaacagggccagtgacaggaatggagactcagacaaagagagcagacttatggacacgggcggggtgcggcagggagggtgggacagaactgagagagtacattgaaatacatacattaccataggtaaaacgtgtcccagggacgggggagcctgatgcgctgccatctatggggtcgcacagagtgggacacgactgaagtgacttagcagcagcagcagcagtctttatcttggagaaggaagtggcaacccactccagtattcttgcctggagaatcctacggacagaggagtctggttggctgccttctatggggtcgcacagagtcggacacgactgaagtgatttagcagcatcagcataggtaaaatgactgtggctcagatcatgaactccttattgccaaattcacacttaaactgaagaaagtagggaaaaccactagaccatttgggtatgatctaaatcaaattccttactattatacagtagaagtgacaaatagattcaagggattagatctgatagagtgcctgaagaactatggacagaggtttgtgacattgcacaggaggtggtgatcaagaccatctccaagaaaaagaaatgcaaaaaggcaaaatggttgtctgagaagaccttacaaatagctgagaaaagaagagaagcgaaagcaaaggagaaaaggaaagatatacccatctcagtgcagagttccaaagaatagcaaggagaaataagaaagccttcctcagcgatcagtgcaaagaaatagaggaaaacaatagaatgggaaagactagagatctcttcaagaaaattagagataccaagggaacatttcatgcaaagatgggcacaataaaggacaggaatggtatggacctgacagaagcagaagatattaagaagaggtggcaagaatacacagaagaactacacaaaaaaagattttaatgacccagataaccatgatcatcgtgtgatcactcacttagagcgagacatgctagagtgcgaagtcaagtgggccttaggaagcatcactacaatcaaagctagtgaaggtgatggagttccagctgagctatttcaaatcctaaaagatgatgctgtgaaggtgttgcactcaacatgccaacatatttgaaaactcaccagtggccatcagttcagttcagttcagtcgctcagtcatgtctgactctttgcaaccccatgaatcacagcacgccaggcctccctgtccatcaccaactcccggagttcacccagactcacgtcctatagagtcagtgattccatccagccatctcatcctctgtcatcaaccttctcctcctgccccctatccctcccagcatcagagtctttccactgagtcaactcttcacatgaggtggccaaagtactggagtttcagcttcagcatcattccctccaaagaaatcccagggctgatctccttcagaatggactggttggatctccttgcagtccaagggactctcaagagtcttctccaacaccacacttcaaaagcatcaattcttcggtgctcagccttcttcacagtccaactctcacatccatacatgaccacaggacaaaccatagccttgactagacagacctttgttggcaaagtaatgtctctgcttttgaatatgccatctaggttggtcataactttccttccaaggagtaagcatcttttaatttcatggctacagtcaccatctgcagtgactttggagccccccaaaataaagtctgacactgtttccactgtttccccatctatttcccatgaagtggtgggaccggatgccatgatcttcgttttctgaatgttgagctttaagccaactttttcactctcctctttcactttcatcaagaggctttttagttcctcttcactttctgccataagggtggtgtcatctgcatatctgaggttattgatatttctcccggcaatcttgattccagcttgtgcttcttccagtccaacgtttctcatgatgtactctgcatagaagttaaataagcagggtgataatatacagccttgacgtaatccttttcctatttggaaccagtctattgttccatgtccagttctaactgttgctttctgacctgcatacagatttctcaagaggcagatcaggtggtctggtattcccatctctttcagaattttccacagttttttgtgatccacacagtcaaaggctttggcatagtcaataaagcagaaatagatgtttttctggaactctcttgctttttccatgatccagcagatgttggcaatttgatctctggttcctctgcctcttctaaaaccagcttgaacatcaggaagttcacggttcacgtattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgatgaaagtgaaagtggagaatgaaaaagttggcttaaaactcaacattcagaacactaagatcatggcatacagtcccatcacttcatggcaaatagatgggtaaacaatggaaacaatgagagactattttcttgggctccaaaatcactgcagatgatgaccgcaaccatgaaattaaaagatgcttgctccttggaagaaaagctatgaccaacctagacagcatattaagaagcagagacattactttgctgacataggtccatctagtcaaagctatggtttttccagtagtcatgtatggatgtgagaggtggactataaagaaagctgagtgctagagaattgatgtttttgaactgtggtgttgaagaagattcttgagagtcccttggaccacaaggaaatccaaccagtcaatcctaaaggaaatcaatcctgaatatacagtggaaggacggatgctgaagctgaagctccaatactttgggcaccttatgtgaagaaccaacacattggaaaagaccctgatgctgggaaagattacaggcaggaggagaaggggatgacagaggatgagatggttggatggcatcactgactcgatgaatgtgagtttgagcaaactctgggagatagtgaaggacagggaagcctggtgtgctgcagtttatggggtcacaaagagtctgacacaactgaatgactgaactgatatctaaaatggaaagctgctgtataacacaaggagctctacctggtgctctgtgaccaggaaaatgggagggaggttcaagagggagggaacacatgtatgtgctgtgctgtgcgtagttgctcaatcatgtctgattttttgttaccccagggactgtatgtagcccagcaggcttctctgtccattaaattttccaagcaagaatactggagtgggctgccacttcctcctccaggggatcttcccaacccagggatccaactcccatctccaactctgcatttgcaggtggattctttagcacagcaccacttggaaaggtccaccaccacgatccaacaccaacagagattcatctcccgtctcttgaggcccagagcctgccagacatgagtctttccccacctctcctcagcctccacatctgctaggagggagcaaccctccccagctgtctaggcaatggagcctggagctccctggggagcacagtctctcctcctgccctgcgcagcaggtgggtgctcccacactgcaagacagatttctaattgcctgcactttctgccctctatcccagggcggggggctggggaagctctgggtccctcccctacagtcaccccccagcttcgttctggcagctaagctctctctcgggcaggagctggcacctcacccaggaggggagaacagctgcggagatggtgggagaattcctcccgctgctggatttgtaaaacaattgattaaagacaatgcaattaattattccttgatgaaatagtggaaattaccccaagaaaatgaagatttcagcagcagaacattaaatccctctaattatgtcatttctaaaaaaggggggagggggataaaaagggttgaaatggtgggccggagggaggaaaaaagtgtaaaaatagatggggtgactctggggctcctgcagggtgagcaggggcaatagaaggggtcaccgccctggcccggaccacattgtttgaggggaaagtctgaggtgacagagctctcggcgggggacagcaagcagccgtccagacactgggatacgtgccttgggtgcattagcaaattatcctcactctgaatcccggtgccttattcccgttgtacataggagagaatgaggctcggaagaggcacgtgacttgtccaaagatgagctactaattagtagagacaggccgtgaacttaggtttaactccagaaccggtgctttttcaaccccacctgctgcagtctatggcagtagccactgcagatgcccttggcagaagtggctgtgaccactagctccctgagggtctcagtggctcactgaagggctgggtgtggcagggagggtagctgccaggtgttgccatctctgccaataggaattgggcttgagctcccctgggaagctctagcccttcatcctctctgacacccctgggcatacttttggaagccagggaggggtggcaagtgggacctgccaggggcctagcctggcctggttctctctccctgggagacccagatgctccactagggtgctgatggcctaaattccaatctggccttgctggggttgccatgtggcctcgggcaagttcccttgccttcctggacctcagttttcctatctatattaggggatataagatcagtgcacgtatgggtccatttgagggtaccagatccagctcttcctcagctcagtttcaagaagccagaatcagctctagagtgggcaacaggaggaaacagacaaggggaagtttgagagccagcaaagaggaactctgggttctagcttctggggctaggctaacaggaatcaggaggaatccaggaggtctgtaagggggcagtgggtggaaggctatcccaggagggaagagtgatctgagtgggaggacagaagaagaggggcctggattgaagttagaccactaccccccattcctgcctcaggacaccaatcaaggggacccattgcctggaatggctgggcctggcagggcctaaagcagaggataattgattctcagcatcgctgaggttctttttagagcttgctttgtttccctcctcttggaccatatctgagcatatcccataatttttctggacactctcaggcactatcagtctcatttttatgagttaaaatttccaatctaatctagcatcaaaacttcaatttctcattcaatctaaagatttgctctttccctctctagctcaggcccaacccagcctaagaagcattcaaaagggatggaaggcctggtcctccaggatattggggctaccagatcctctctgtgcagtatttttggtgggactttggagtccccctcactgggatccttcagctagtaattccctgacatgtgcaatgatgctcctgcttctggggctcatcccactcagtctccaagaggtcacctggcctcaacaggcaggcccttccttcagcatgccttggtgtagccgctccgacccacagaagagcctgggcttgccagactatccccaccatcctagacagctccaagtcaccaccctcttctagactcttttcaagccagagtcaggccttggccactgtgccaacccaatgcttggggatacatgtcagcttttccaaatgtttcccctgaagctcccactgctcacacaatcaaggtgagggtagcagggcacagtcctcactgcccatctccccctgcctcacctcctcaccctcacttccctctgtgtagcctggaagtaagtagtgagggtcacagaaccaacttgggggcaccaaccttgcaaggcctgaagagatctacatccccatttaaaatgtgggagttctgggcactagttactctccaagcactccaagtacgccgtgtcccatttggacagcctattatgaaagcaagcctctgcttctccaactggttctgcctccttctttggccatacccctgtccttgtcacctaccccaagtcccaaccctctctctgtggcaggaccctacagcctcatgtccactactgagaagcacattcactccagccatcctgcagtgcctggatggagattgtggccccaagcaggctgcctgcaaagccaggcctcaaacctgggtgccaactcacaggccaatgcttcttccaccagctcaacccttggccatcctctctccaggagggatgagctgactgatggagcggctggggcagggaagagtcctttcccctctcgacaccagcagtggttcctacaaaagcaaagttgggagtttgaatcctggtgctcctactccccagctggctgattagaggcaagttgcctcatatttctgcaactcagttttcccccctgtaaaatggttatgataatactgaacccagagggttgccaggaagggtaagggagatgaggtcctagtcaggcattggcacaaagcaggttagtccccttaggacccctcccttgcagtcaggataccagggttccattccaaacccagagactaattttctggcagaaatgggtcttgaacttcccatttgtgtccaggaaagaaaggccacagagtggtgaggcagaggtgggagtctgaggggttaaggaggggaccctggaagagagactttagcattaggggtggtaggggcacagctcagatgggaagggctgttcctccccacccatctgctcccagacccctcccaccagagatggcattctagcccctcccacagctccagcacagatggcaggaaggaaatgccaaggcatggaggtagggaggggccaccaagcccccggaggctccagcccttgccaagtttcccagaggaggaggatgcaaaagccccctcccttgctatggcactgccctcccagagccacagcccactgatgccctggtgccttgtatcccgttgtcatggtaaccaggactagctgacgtgccgacaggcagaccaggagccgctgccacatgaatcacttgaacttgatgtgacagacccaggcgggtggcctgcacagaggcagagggatgtggtgccctgtgggcagggacggctcaggctgaatctctccaactgtgacaggtttaggggctccagaagctcatnnnnnnnnnnnnnnnnnnnnnnnnnnnnnnnnnnnnnnnnnnnnnnnnnntttcctgccctcactgagcttatgttctagtgggagaaacagacccaaaacaagtacccaaaccaacaaaatgccccaggaggtgatgaggctctgaagaacacagacaaggaactgggctgcagagcaactgggccaagggcttattttaggaaggatgatcagaatggattttctgagaagatgacatctcagctgagacctaagtgatgagcaagggctgaactctcaaatgaaaaagagagagttccaggccagggacagcaaaagaagaatctgagatgtggttgaagcacaggaggaggaccactgtgaagacagtagggcagacaggttaagtgtgaacggtgattttatcccaaatgcagtgagtggtggaaagtcaaggaactttgaataaagaagcaccatgatttgatttccaggtacatgctacaaaagctctagctgccgagtggagaacaggccttctgcagcaagcccaggaagaagcccgctgcagaagtccagagcacagaggagggtgctgtgaacccacaggcaataacagagaaggagagaaatagccatcttcaagaaaattctcggagacagaaactccaggacttgtttctggtccatataagagaggtaagggaaaggagagaaagaaagacaacatgtgggcctctggtttgagtttatgggttgtttgctgttgttcagtggctaagctgtatccgattctttgtgaccccatgggcagcacaccaggcctcccttgtccttcactatcttctggagtttgctccaactcatgtccattgagtcgatgatgccatctaaccatctcatcctctgtcaccgccttcttctcctgccttcaatctttcccagcatcagggtcttttccaatgagttggctcttcgcatcaggtgtccaaagtgggtggttagtggtatcaatttctaaaattaggagaactgattagtttgtagatcatctgtaaagacagggcttatgttcacgagacaagtccaaggggctaaagtcttctctgaagggtggaaaccacactcctaacagagaaaccttcaggatgggccacttcctctccactgtccccaggcagtcccccagcctttccaaaagaagtgtttggagaggctacatggccatggccctcggtgagaactctgttttgaaagtgacagaaacctaactctgaatttcataggcacaaaggatgatttagtggcttgcagaatgcaaggaattaacccatgggaatggaccagagagcagctgggcctgttctcctctctgcctctccccacatcccagcttttccattccaaccacaaaccaacttcttccccaaggcaggaagcactgaatcctcaggatttttaaaaaagaggaatcaacttttttcaaaattgtttttctcttcaatagaccacctttggtctaaaaatattaagaaatgtgacaatgaagtttgtgaatgaaaccacgacacaaatggagtagtttgtttactactcaaaatcacattagtaaaaaacttcactcttctaaaaatgattcacatacaaaagtagtaaaactagtctaaaacaggaaaaatataatgtgaaaaaatttataaaagcatcctctcagtttttatattctgtaacttccaatgactctcatttccagttgaaaaacttaagagaattttaattggctagggttgaattatatgctactgttgggcccatcagctttgccacgggtggggtttctataagaatatgacagctcacactatgtccacagctcacactaaggaagggctatgatgcccaagagacagagatgattagacaatgctcttttacatgatatgggtcagcagaattcccaaccagagagatgaaagggaaccatgagaacaaggaaaaatttgcaaattttggagaactgagcagtttttacttggagttccaggaaggacagccagagaaatgcccacggccctcaaagctatctactgagagcagaagataaaaatcattgtcctgatggagtttgtctgtgtgtgtgagaaaccagaggggcagtgtccagactcgaactggttgagtagggttccaatgatgcccaactgtaatatctggtaaacccttatctccccccagagactggcgttgccagtcaaagagcctgcagatggaacctgaattggcaaagcagacagaagtggaaggtagtcagtcgattgccttccaatgagtgggaggctctcgagcccctcactagccatgcagtcttggataagttagatttcacatctctgagcctcggtgtgctctgattttaaatagtgaatgtgcaaaaattaaagaaaatggtgaaagtgtaaaattaaataaggtataaaggagagtgcctctctcataaggtcaagtgaagagatgatgatataatgcaaggaaaatacctgctacagaggctggcacatagtatgtgcccaataatatcatctaatgctttcatcactgctacagaggaggtgtgtgaagtgggtaggtctgagagctttccgttaacgtttaaaaaaatatttatttatcgctgtgggtgagctttctccagttgaaacgagtgtggtctactctctggttgtgcagacttctctcattgcagagcaaggactctagagtgcgctggcttcagcagctgtggcccacaggcttagttgccttgaggtgtatggaatcttccctgaccaggaattgaacccctgtcccctgcactggcaggcagattaccagggaagtccttccattaacttttgagtgcctcctagaggacagtttcaatatgggaggctttcattcttggcattgactccaccccaggcaactgtaatagcaactttattctctgatccacctgctaagtgtcaggcactgggctaggtactttacctctattatctcatttttgagcattatcagcaatgactcgagacagtgtatcagttagcttctgctgcataataaaccacccccacactcatagcttgtaacagcaaccccttacaaagctcatgattttaaggttgggacatccagcgaggctcttctggtcttggctgggcctgctcatacatctgcagctgctagttaagtggctccacttctgggagttgcctggctgtcatctgggtgatggggatgactgagccatgtgtcttttttcatccagcagagtagcccgagctttttcacagagaagctgggcagggttccaagagaacatatgaaagtgtgcaagacctcttaaggcttgggttccaaactggcactggcgcttccaccaccttcaggtggccagagcaggtcacagggacgtcccagattcaagctggtggggagaagcttcacggtgagattgcatcaggtgggctcagaaagaggcggagaaatgtggctgatcttgcagtatcaggctttccttgtgactcagctggtaaagaatccgcctgcagtgcgggagatctgggttcgatccctgggttgggaagatcttctggagacgcgaaaggccactccagtattctggcctgaagaattccaaggactgtttagtccatggggtcacaaagagccggacacgactgagcaactttcactttccttcctttgcagtataccactggtatactacaagataggtactggtattactgccatttcacacgtgagaaaattgagactcaaaggggtaaaaatgtcttgccccagtgatgctgctagtaagcatggcagaagcaggatttgaacttggggggtctccacactcaactgcattgggacatgcaaactccattctctcaacggaagcacccttgtctggcacagtccacaagggcccaatctaacaggcaccagaggacttgactgagatgagggcggggcgggagcaaataaagagatgaactggaagaaggacaggagcaagggattcagacagagcctgtggccacgacaaggatgccagcttggcgacgtggacatcagcctgcctcatgaagccacagaactggacaggccaggccagggctgaccttcttccaggcagaaaccctgcctgcacctcacgctgacagggccctgcggtgagcctacggtaaaggagctgcctctgctgcctgctgccgagtcctcagaccatgggtggtgacagtgctggccagaagatcaaagaagtgtcacaggtgaaagcagagatctgttctcctgtgagcattcagagcactccaagctggtctctgtgtctgtgccgagggtgagcagagagacactgggctggccgtgaggcgccccacctcctcacctcccctgtgaccggcccctcccccacagagaaacccacgccaggagcacagctgtgcccagccaagctgccgggtgccaagccgggcctggcgggctccctctcatctgtctctctttagcaggaacaaatgggaatgagggaatcaattaacaaggctccttagccaaatgactgctgctccctccttccccagcctgttaacccttcgctgccagggccgggaagggctgccccggctggccgaccgcactcagccctggggcccccatctggatgccgcgctcctgccttgtctgtgccaagtgctggcagcagctgccaagctgaggaaccagagccagaaacacagacacctccattcaacctcagtggaatctggggtcaggctcaaaggatcttcagggcctccggcctggccctttcttttctctccagagacccagggcctcctcctgcatcaaaaaccactgagaagaaggttcaggccgggagggtggctcacggccaaacctgacctggggcccctactgggtctaggaaagggtaggggcccaggggacagggcaggacaccttgggccacactcaggaagccctgacacctcgaatgtcaggagcaaatggtcagtctaagaatcctctcagcggaatttggacaggcaactgtgggggcctggttgtcaggaggcctgagttcaagttccggcttaacagctgacatggggtctgatgatattttgaatgattaatcaataggccactctttctcccacccactctcaccaaatgtctttatttgtcctccaagggtcttttgtctttcaccattcccactgtcccttccccacccaaccccaacccgccagccctgcctcagtagtcaggctttggtttgagctgctgctgctttaccggattcaggactgccatgcaaagcctgatccaccatatgctgcggcactggggtcacagagaaacaggggtgtgctcttggccttttttatattcaaaagatactcaggttctaagttcagaccaaaaaactcagatgcagctcacatggagagaaccacctgcacccaccccctggattggataaaagactccaaaggctggaagaaggtggcaaaggggaccagagaggacatgtcagcaggaaggactgcctacccagccctgacactggagagtgagctctgggcccagcaaggcctgagacacattcatccatccattcattcattcatttgacaaatggacagtgactactttctgtatgccagacactgttctgggcacagtggatgagcaacaaggaccctggccttgggcagggtgaggctgaggacatgagagtcactcagtgatggccctcagccatttatccagcaattgtccagcaggagggaggctgttggtgccctgagttttgcctcagcagcaccctaggtcacccaatggacacggcaccatcctgcccggcttctatccccaggacacttgtgagccacctgggtgaagatgggtcctagacaagcaggggatgataagaggacgggaggagaggcctgagaggagactgccagcaagccaaggtcatgctgaagccacaggactgcccctccctgcccctaacacattggccagtctcctttctaaaactcaccttgggcccaagttcaaaactccagccacaactggcctggtgtgaatcagaagcccatcactaagccaatcagcactgcccaggagtagggatctataaacaatggcagctcccattcccagagcagggtgagcatggggggaaatggttccctgaagacaaaaccaccaaaggccacaatactgaccttggtcgggcaggtggaaataggttgagcctcacttctctgacctgtaaaatgaagctgatgagagtgccagcctcactgggctatctttagggttaaaggagcccattcagatgagagcgctttgcacacaacaggtacagaaggaatgagagtcaattctctgtcctcagtcactccctctctaaaatgggtgggtgccctggctcatttccccagccctgatgtcccaggatcccacagccctgagcctccatgacaggcatgagcgatcacagactctcctctcagaggtcaggatccccttctgttcctcaggactgggaaaatcctctggctgctcttcatcttccccacttcagtctccccaggccctatgactgtcccccccaccccccaaccctctgagtttctgcctggagaagtggatgtgccaatgtgcagagcttgaaccagagttcagatcccagttctgctgctgcctcaaggctggatgatcttggtcaggcttcttcacccctcagtgcctctgcttcctcatctgtaacagagaacttaactacaatagacactgccccgtgggggcgctgtttctgtgtcgggccctatgcacacgtgctaagtcacttcagtcatgtccaattctttgctaccctatggactgtagcccgccaggcttctctgtccatgggattctccaggcaagaatactggagtgggttgccatgccctccttcaggggatcttccccacccagggatcgaaccagcgtctcttatgtctcttgcattggcaggcaggttctttaccgctagcatcacctgggaagcccttaaggccctataagtatcagctattcaggttctcatctctgttggctcctggaccaccccattgggaagtagcttggatggtaggagtgagccaagcactgggcacagaggggtgccccagactgactgctgccaccctggcctccttgagttccccacctggtggaggcagacgcatcagcaggcaatctcagtgcagagagaccagggccactctctagggaagcctggggagaagtgtgcacaagattggcccaagccaaggagggaaaccaaggcctgctgggactggtgacaaccggaagctagtacaagtgggctgggtgaaggggggttcaggataggggtccaagcagaggggtcaactgtatagggaactcagccatgagagcgggccaggagacagcatggaggacccagggtgctggcagctgcactccagattgtggagcctcagggcctgcctcgcacaggactctgtgtctgggtgtgactttgtgtaatcgactggggctgtgtgtgtatgtgtgtggctgtgtggtggctggtgtgcttgtggatttgtttctgtgagggactgtgtgtgacagtgtgaaatagtgtgtttcgaagagggcggagcttggcatgcctgtctgagatggtttagggggcgatcactgcggctgaccactgtgtgtgactgtgtgtccatgggtgtccctaaggtgtagataagtagccgctggctgtgagcaggactatatgcatgtatggtatttataggtatatacatggaaggtgaatgtgtgcgtatctctgtgtaggtgtgtgtgtgtgtgtagacatgtgtactgctgtctgtggagtccagggcaatgagagctgctcctccttccagcctggctgcacacgcacgggcgcgcgcgcgcgcacacacacatacacaccacacacacacacacactcacggggctgggaggggtggctgcccgttgctgccacagccagtcagaacttgctaatttgcatgttaatgaagctcgggagctctccagctcgagactgacaggagcccccggcgcccccccacatccttccctgacgggcctgggagggggggagtggggagggctgagaaccggcggagggaagaagaggcggaggaggctctcactgtagcttccctttctctctccctttctccctctcccacccctgtgccggccccaggccccaccacgtgtctgcccgcccctcagccccccttcactctccctcctggcccagcacagggagagggggctggggcaaagcccccggggcaatggcagaggaggctgccaaggttcccctgaggtgaggctgggttgcctacccctgcctctcagggagcacccagcagaccagccataggcacccacccaggagcagacaccccgggatgggacatctgagagtggaggggtgccaacacaggcaacaggccgccctcctgtctcccccgcccccgcaggcttcagtgcggccaaggtgggtcaccacgagctcttccgcctgcacccccgagaaagggtcagtccatgcgaggtcagagctcccgcccagggcggggtggggggtggcagggatggcacgaggactctggagatacaacgtggggggagggactggggtacacatggaaggtgcctccctccccccagggctgtgctcgcagggaaggaaggctgggtggggtggtgagtaggagatgggagccctcacagctttgatcaacaggtcagtcctggttgcgcggctgtctcctgctcagtctgttccttaccgcattcttgtctgatcccggtccttcaccgtcccatccccctaccactcctgccccatcccctccttcctttcttaatcagccacatcccacaggaggctgagctctctggggagcccttggcagccgcctcctagaaacactgtctggttttgtctcagaggtgtgtcccctgccttgacagagagctggtctgggctgggggtcctggctcctgccctctcagcctggctcccaatgagcattttctccttcctctgccttcccttccccaacattgctctgggcactgggtctggctccctgcccctctgtctctccctgagcccaagtctctatctctccctccttttccccagatgctcaaatattcatcttctctccccacccccagtctctctttctgccttgccctgtaggtctctaaacacccacccctgcccctactcccatctccccctgcccccccacccccggtggcaggcctggcccccaggtgtgtctttgccagagaggggaggcagagaggtgaggacccctcaggccctgaatctctgcaggtgagaggggagctgggcagttgctggtgttaattgcagggaggatgtctggcagaaataaggtggtttttctgcttcagtgacgactgttacaatcaaattgtccacagacaattagcggagtgggagaaataagaattagatttctaattattttcccagtaaaagccgccctggaccccgtgggtgagggggaagggcttctcagtggagccaacaggcacttttgtaggccctgctccctggggtgggggagcctcatgggagctccccaggcaggcaggaaggggctggaaagggcagagaatccggacacttggatctcagaaccagccgccatgggacttgctggcacttctcattttttgagccttagttttctctttccagaatgggggaacaaccattcctaagtagcagaattgttgtgaggagtcaaagaggtgaagcagcccccagtacaactcacgactcacacacgcctctgtggacttgcaagctcgcacactcacacactggggaagtttctccttccaccccctttgctgctctgggtctgtgtgtgtgacacatgccggggactcagggaaagggggcctgaacccaaggagagcctcactcaacagcgtgtgcctccctgagctgtgagcctccatctccacatctctcacatgaggttacgcatggtgccttccacctgggctgaaatgaaggttaagtgacacccacgatgggggcgagcctcagacctggccccacggcaagtgctcagtaaaatgaaagtcctatccaagggggccagcccgggcctgcggggctggacacagggctctgtgcagagtgttctgggtccaccagacccaaccttcctctggggcctaatcactcagagaagtgaacagaaaaccaagccaagaaggacccaccctacggatcagatagttctgggttgtgtctgggctgtgtgctttctagctagtcaggcagtgtctacatcccctctctgaacctcagttttctcttctgtaaagtgggacaacagcagtggcttcctctaggagttgctccaaggctgtgacattaatttgctcctggtaggtgctttaggagcgggaggggctagaggcacaatcgccctgactggaacaccatcccccatcccccacccttgtcctgcacagagtcaaggactaagggtgggagcctccgggttgccctaggcctttaggacctactccccatggagcagagggaacacccagctcactaatgtcctcagggcccagactagtgacagtcaacacacctgcacacagaagcgcccatgcaggtgccacacctgaccgcactcttgctgtcacgtttgtgcatgcatctcaaacgctcacacgcacacatacacccttcctgatgcggccagaatgtccccatatgaaccaaggggaagctcctggccacacccacgggggatgagccgggagaggcagctgcaagccagctgtggggtctggagtgggcgaggggagctgcttggatacccagctgggagtcgggcaggagggcttctcagctgtctcttggctccaggcccccttcctacctctgggggccagctggcccagctgggcagggtggaggtcacctgcctggaggtgcctgtttctctctgcccctccccgcggcctttcattcagcaacaatacctgggaccccgcccaccttctgtgccatctcccccctcccttcccactctctgtctctctgtctctctgactccttctgtctctccctgggtccctggatcttgtctctctgggcctgggtctccccgccccagtgctgggctatgtaaatgtggtatttcccgtgtctcatcagcaggactgcctgcttggctcacatttaatttgatccgtggcggcgcctctgcggagccactcatcaaagcgggaagacaattaggtgaatgtcagggtggcctaggccccacggggtgaccagggcctggggctggggccatgaagtgtgaggggcaggggcctggctgccaccctcatctccctcggggcctgtccagacttggcccaacgtctgcgggctggccagccgcctggatggcccctgtgaagaccaagctcctctctgcccaggacctgcagcactgaggaactgaggggcatggctggagctcctggacttggcagaaccccctcctcacccccaaaaggaggcagctgtgtggctacagtcaggtggactcctgggctgggccctcgacaggcctggtagagggtctgagctctgagctagctcagggtcccctgagaagggaatgcattctttccaccagccccgcccggcgcgcccttgctggcgccaagccagcggtcctctcctgagcctcagcttggccttttctcctccctcctctgtgttgcttcctctccttctgtctttctttctctggctgttattgtgtctcttccccctctctacttctttcctcagtctcattcctttattcccaacctctccttttctgtatcttataccacccccacccacccccatcatgtccttggcctcctgggaccctttagcctcagctgctcatctgtaattccccatccctgtccctggctgatccttccccacctgaggctgacctgctaggtaaatctgaactccctgccccagcctgacttcctcctcactgcccccgaccctcagggatccctgaatctctgacacctccctccctactggcttcttcatgttagctgtcaacacattcaagtctctcctgttttaaaaacgataataataataaaatgccttttaaagagatactctccttgatggccccactgcttcctccacagcccctttctctcctctccctctagggaagcttctgggagagcaatctactcttgcttctgacccccttccaagctggcttcgggaccacccctcaggccctagaaacagtcctcaggaaggtcaccagcaaccttctcatcactcagcccccttgatcacacctcacttggatgcccagacagcatctgaacaactgacttctctcttcttgactctcccttattcacacaatgcctctgggttttgcctccacccctttggcctgccccttcctggaccccacctctgccctggcctcacagttgccctccagagccatcccagctcctcttctccattcaccctctgtacagctccttaagtaatttaacccatgccctgctcccccgacccaggcttcagtcacacttgtgtctacacctttggccttctgctctagcccagctctttcttctgcgcttaggacgcaactattcactgcctcctggcccctccctgcgtgttccatggccctcccaaacccagagcagcccaaaccctgacctttcaagcctgtttctccttttgggttccccagttggatgactggcactttcatctcccagtttcccaaatcagaaacctggaggtgaaaccagagctcctttcccccaccactttcacacagtgggtgataacagacgacagagtctgcctccaaaatatttctcttctataaagccttgaaagtccaccctcactttccccatcctccctaggcagacctgctcaagccaagatgttctcattgttcccttggaggcatcttaatgcttttccacctgcaagtgtttactactttttatccccacatggaatgcccactttctcttctttgcctaacccatgtcaaatccatcttgcccctcttcttaaaagcctagctccagccccctgcaaggaagttctcttccctccatcccagctggcagaaccttctcccaccctaagctcatgaacccttcttgtctggtgcctggacacacaggatcatctccgctctttctcctatatacatggtctcctacatttcccaggctccttggtaagtgggccatgtgaatgcttctggccaatgagctagagataaaggtgaaatggtcacttcccagccaaagcatacaagagctagtgtgcaatcttctagctgccacagcaaccaacctctttggagatggtagagcctcaagatcaaagcagcatggaaagctgagtcccctcatgaaggacaagagccctcagatgcctggtcctgcagcagactttgtttaagcaagaaataaacttttgttgtgttcacccactgtgattgaggggttgttggttaccgcagcatagcctttcctatcctgactaatacaggccttttggagtgttattttcccatctcttgtctgaggataacattctgctctcactgtggtagtgagaattaaagtattaaaacatccacattcagcttctgagtgcctgctgcatgtcagactcagtataagtacctgactatgagatctcctagctggaaaagtattatgaactgaatgcttgtgtcctgaccgcccccctcctcaagttcatatgttgagacccactactatggtgtttgaaggtggtgggcctttgggagataattaggcttatatgaggtcataagcgtggaaccctccgtgatggtattagtgtccttgtgagaaaaggaaaccttaaggaagccattgcaagccaggaagcaccaaaaatcaaatttgtcagcaccttgatcttggacttcccagcctccggatgtgggagaaataaatgtttgttgtttgagacacccagtctatggtactttgttacagcagcccaagcagactaagacagcagggctccatttatcagagagaagagaagatagctacattcagctgctcaggttgggtactgaacaatcccagcggggaggggcactggcagagattataatgtggaagtcactccctggagctgtgaactgtagaaaccctgttgtcctcctagttacagtgttgctttaaatcactgataaacattgacactaattttgtagttataaagaggaagagttggggtggggagggggcttgaaaaaggcacgggagaaacaggaacaatgcttgtaatttcatagtattaataaaaaataatgatgtcaggaaaatttcacatcgtgctgctatgtgccaggtactactccaaggctttcatttacatttattcatccatttctcacagcagccctatgagataaacatcatcatcccccatcttacagatgaggaaattgagtcagagataaataacccaacatcacgtggcttataaatagcaaagctaggatttgaactggggcttccaaggtaaagaacacgcctgccagtgcaggagacataagagacgtggattcagtccctgggtcgggaagatcccctggaggagggcatggcaacccactccagtattcttgcctggagaatcccatggatagaggagcttggtgggctgcaatccactgggtcacagagttggacacaactgctaagtgacttagcacacatccacaggatttgaatccgggcgttttggtttcagaattgctctcaatccctctcctgttcgggctcctaaaatgaggataatgtgcaattcctcccccacctagggcctggcctggatttgagcttccagggttaggatgagggcaaatgctaaagcaactgattttatgagggtgtctgagaggacatgtgcacagctctctggggcccagggcacaaggcacagagctgagcaggaactcagcccccttcaccacttccattcctgtaacccccacctcctgctaccttggcctccgtacagaccccagaagcaccgtggcatccaaagggcagggcatttgaaatattcaggggccacccctttggcctggcattgatgggagggacagaagggaagattctccacacatgttgaagggtggcagatgggcataaacaggagtttgggcaggacaaattccaagcctgaatcctttgagcataataataaatgcaaatgtgacctctcacattctcaaaggtccttcagcttgtgacatatcatgctacagacaggaactcattcagttcttatatcaacccatttcacagatgaagaaaccaagcatcagagaacttgaatgcccagagtcattcagccattaggtagcagagtctggcagatccagggttcacacaatgtccacatctccagctacccccagaagtgccagtcctcttgagagaattccccatgtccccaagggtacctcctactgggaaccagggtatccaggtctcctgcaacctggcaggggtctgtctactagggtgagcctttgcttcacccgcccacccgtgtgctagggacagaagggggactttatgtgcaatctgcctgactctccagaaagcacttaggtttacgatgtgcatgaaattgatcgccagttggcgcggcccccgcgcgctcagtgccagcccagtgctggcaggaggctgccccccaccccccactttcaaggagcatcaaagccgcctgccaaggcccctcgtgagggtccttctccactaacaagtgctgagtggcggggggagctgtgcccaaagacctttccacagcacacatacccccgccccacagtagttaaatagctccatgttttatgccaattcctgcctcttctgcttcctctctaacaagctgatgctttcaaaggccccactaattggtgtttgcacctcacacaccacgacactttgatagtcacttaggacatgggtccgtccatcacacccttggtacagagggtggttcacctccctgcagcaaggtgcccagcctgggtgctcctgctcctgtgcgcacacaggagagggcccgcgtgccttatgctgtatgtggaggacacgtctgcacatatatgtgcacgtgggtataaaaactccttcagaatatctcttgtgtatattcctgcttgcgtgtcagtgcgcgtgcatgggtgaacactaccatctgtgcgtgtgggagtatgcagtgtgtgcctgtacatttccctgggcgtgtttgtgtacccacgtgatagagcttgtatgtgttgatgcatgcactcgtatgctttgcatgtttgtgtgtggatatctgcttgcaggcaggccggtacttgggaatttttgcaagttgactaacaaggtacatgttcatgtatccatgggtgtatgggtttgcatgcctaagtgcaggggagggtagacacgtccatctgtgtgcccatgcacaggcagggtgcagggatgagggaatctctggttgggcaatctacatagcacgcatgtacttgggcatatgctgtgtgaagaaaaggtgtaatacaatagtcaagggcccacaggctttgggttcgagacccggctctgccactttctagctgtgtgactttgtgatgaccactgaacctctctagtcacatctgcttatctgtaaaatggggatgataaaagcatctgtctcatattgctgttctgagaatcaaatgagataatacacgtagagggctagtccgatcttctctcattgctgggcacacacaaccccatctggcctcaacacggagttgactgcccaggagagaccctgggcacttggggagagaaatggccagccccagaccacacagtaacagctacaacctctgagatcttcatcacatccaaagtgatttcacacttttattacctacctttgaataggtgggaaactgaggtgctgaagtaggtgggagtcggtggcagagcaggaacttgctgtcagaagacagcctacagctgagctgtgggaagctgggatgtccctcatttccaagggagagggggcggcttcagaaggatggagtaatgcacacacccgtgcgccctatgcaccaacacacgactcagaacaaaggggtttccttacctgtcccagcctggggtgcctgcctcgggggagcatccctgctggggactcaggctgagtactgccacccccagggtgcccagccatgtcccttctgtaaacccagctgtagttgtgtctgatctgtgttatcttctcaccaagacactgaggcacagagaggggaagaagcttgttcaaggacatgggacagaaaagagcagaagcccccagcaggcaggccaggattctcatctcttgctctcctccttcaccatgcagccttcactgcaccaaccaggctggcgaatcaggggtcggggcaaagtcctccccacggcaggtcatagggccttcaaacccacccaaaggtcatattttgcagggtgatttttttatgctactttttaataaaattttaaaaacatgaaaacttaaaatcacaaccagtagcagcagcagccctgcttccttgccagtcaacattgcctctgtcattaacactgccttccccctgagccatcaccctctccagcatcagtctgactgtgcccccacctccaactcccaccccttaaactgtggttacccccagcccttcattagtgtctcggacttggccccaaaaccaagcagaaatggttttctgccaccctttgcatttcatttctcctcccaccctcggggcttattccaggatcatctgacctgaagcccttcccagatctgtaaccctccctgctcccctgagcccctggcctcgcctgtcctgcagaaactgcgggctgggctttggccctgaaggcctcactgggggctggcagccaacaagggagccaggaggggcaggagggccaagcagccccctccccaggcctggcgccccacccacccagccggcggcctgtctgccttcctgagctcattaactgcaggtcaccgttcagcaggaaagacaaggcgtgggttctgcgggcgttcattagccgtgagaggaacagtgtgtgtgaaattagcagtcacctgaggacctcgataatttcataattaggaggcctaatggctccagctctggatgccaaatgacttaaccccttgcctgctgagctcctaacccccagtccaaggctgcagtcccctccccctgtgcctcagtcctgtttatttccaccaccacggtgcccagcaccagagttggcacaaaggggctgtgagagcaaagttgatggagcaaatgaatgaatgaatgaatgaagacgtatctgaatgggaaaagagcttcagcccccactgcaggtgatcaggggaggaatgagtctccatctgtaggcatagatgtgtggttgtgtgtgtgactgtgtgtttgtgtgcacgcacacacgcatgtgtgggcataagggcacacacacatgtggatctctgctgtccgcttctaagagccttgtgtgtgtctgggtgcacactcacatctatgatactcattctgctgcctcctgtgctctgcaggtgctctgcgatgaggccccatgtgcctccttgaagtcagcctcccttggcaccgcctaaatactggtgactccataatttctatatggagcacttggaaggaaaagcaggcctcgggagcttaacctgaacctgcatttgcatagccaatataccatttttatttagactgaatgttcatttggggggctggtgttaataaagacagggggctaaagccatatcgtttagtatggggagctatcctgacagcctccaaaaccccccagcctctctcagcctgctcttcttcctcccaacctttctgtggccctgaagaggtgggggctgaggtggaaggcagatcacaccggggtccaaaggctggatcaggctctgcctaatctgggaaccaccgattctgaggatctggtgaccccgcctccctccgcaaatggtggagtggtggttggagaagaggtgagtgtggtgaaagaggaggggaatgagaagagggacaggaagaggttgggggagaacaagaaagggatgggagaacagaaggggaagagggcagaaaggatgggaagtcccaaggaggtgagagggaaaaagagaggagagagaagagaggaggggaggggcgaggaggagaggcaaggaggctgagagcattatcagcacttaaaaagcgagcagctcagttcttctttggcacaaataatggctttttatgaataaatcatgtgtcagacgcctcccagggagtgggcatggaggggggcgcgtctgcggggctccgaggctggcggggaagggccggttgcagacccccggctacaggggtactgcccgctttctcctcatggggcccagcaggacagagctgtctctggaattaccactggcctgagccaggaggagatcagcccttcctctgaggtggtcccgctgctccctgcgcaggagtccagcccatcccagggctgggagtgtccctccgctctgctaccctcccatcgcagagccgcccagaagatgctcctggaagggggacaccagctctcatccaccccgagagagggggtgggccaagacaggaagacacacccagagagggaggcgggcagtgcacacaactcacacaggcatggtctctaccacccggggcgcacatgtgggcacactcggagatggaaacactgtcattcctaccacacatacacacatgcatgcgcacacacatacaaatgctcagacgtgtgcacactcagacagggagaccccaaccaaccctcagcccaccctctctcccagcacacttacacttacacacacacacacacacacatgggcccacacagacagatgcatatggtgcttcatggacacacacagacctgcacacgcacatgcatgcgcacacacatacaaatgctcagacgtgtgcacactcagacagggagaccccaaccaaccctcagcccaccctctctcccagcacacttacacttacacacacacacacacacacatgggcccacacagacagatgcatatggtgcttcatggacacacacagacctgcacacgcacagcagccacccacactccatcagcctagggtgggggcagttttgcaacccatctggagcccagacccagctgggctgtccctgagtctgggtgtggggtggggctggggcatcagtccctggagagagctcatctctgtggtccccacccagcaaggatgacacctgccacaccccacagggaggtcctgccatcctgaaccaagaccagaaccagtacaggctctgctggctccgatctccttgactgtctgctcagccacctccagtcagtgggtgccacaggacagcctgggcagctctgccccttgccaggagtttgacctcggggaataattccaatttcatatgcccctgaaaacaaatctaagataggtgctactgccccatcttctagacctagaaactgaggctccaagagtaagagcactgggcatttctttcaaagaccatgccctttcacaaactctaggagcccacagtgtcctggtcttccttctctccctgtgccaaggtgttctgaggtgctcacctgagcagacctgggtggcccgctcctcccactctgcaccatcccccaggccactcccagcacctccgtgacaacctccacactcttgcttctctgacctccctgtccagcccacaccttcctgggcttctgaccttattatccagctggacatcactgggtcaccatgttgcccaacgccagggaatgccattcacgcaatacatacgttcccaaacattccccccaaatctcaaggggtcccataagacacactgaaaagtcagcccataaggctgagcgcactgtcttccccaggactctccctgcgtcagagttctcaggggaagagccctgtctgcccaagtgcccaaccagaatcagacatcatttgatcctcattccttatgtccaacctacaaccaagtctcaatgactctagagccaaaatatatgtgtgaaattatcctttcccctccagccccactgccctcccttgtcccttctcgtgtgagtcaccaccagcacctctggcctagccactggccctctcccattgttgtcccttctggtctacctgcctccctatcactggtcatccttctatctctgagctctggccatgctaaattgctttttgttctggaacccaaatgatcccttgactctggatctctgatcaagccattccctctgtctgaattctttcctttcccagtgacaactcaccctttaaggcttggctgagacagcacccccacccccaccccaggcaccttccctgagtcctcaagcccaagatgtgtgcagctgtgtcattcgattctcctccattcattacatctctgatctaaaattgcccattaactcatctctgtccccctcaaacctcttagttccttcagagcagagactgtgcctgtgctgctctccggcagccccagtgattggtatgagacctggcacatagcaggtgctcacgaaatcttccatggatgaacggatggatgagtgggcacaggacctgtgctgccactttgcatatctcttctcatttactgctcacgaggtgtgccagccaggaaagcaaggttacagaggttgaaaacttgtgcaaggtcacacgactggaaaatagtagaggataaattcaaacagaagtctgtgtgccttccagggcctcctttccaccatcccagcctgccttgccaggccattttcctgctccgactctattttctcatctgtacaatgggaacaaaaattacacctaacccaggatctgacacagacatgctctcagttaatatctgtgccttctcttccaactctagctttttggggacagaatatccccagaccagaaacttcccgcaaggcacatgttcacagaaacaggtggagagtccacccaggcacatctccagcatccagaactcagtaggcgcttaaccaatgtgtgttgagcagataggcgtccgtgaatgctgacacagatgcagacacaaagtcacaatgggctcaggcacagggacccccgcctccccgatccttgccaattatctgcctccgccgccgctctcctgctagcccaaggcgcgggaaatatttaaaacaattttattcatgaaaatatgctgtacaatgcactctacacggcctcgacacggcacacacgcacacgctgacggcacggccacggtacactgcctacgatatgcgccggggacaccgcgcccacagcccgccccgaccggacacttataaatatgggagagaggagccaggactggcacggagaaaggggtgatgggttggggagtggatccagagctgaggctagctggagaggctgaaaccagtactgggggacgggcaggggtggaaggggagagggacttcgaccgggaggggagaaacaagggcaggcgaggatgagtgggaagggctgaaccgtgggggtggaggtcggagggtggttcaggacttgaaggacagctcaaggtgaacagccgataggtgagtgtgggtgtgttttcaggagaggggttcctggcttgaggtgggtgacgcaaagaccagtgggaaagtgtcaatagggaatcagccccgactttgggtgggcgattagtcactcgagagccctaccaatgatactgaggattcggagacgcccccctgtcgcatctcccagtctgcttcccagaccagcgcgtcccacctcattcctccccattcccacccagccgggaacccagcatccaccccgcaggcttcccgtctttgggaggaggcagagctggcctctggggcttgggcaggaatagcagggtgctccagcgcctgcctaccacttccctcagcggtcagcttctgcgggctgtctctagctgggttggggctgcctcctggatccccccgtggagcggaaatgggaatggggacccggggatcaggatgggaagacagaggcccctgggggggtggggtgcggggcagggcacctggggcgcgcggcaggcggccctcagcctggcacccagctctggttggggggcggggctccggccaggccgggcggcggcggcggcagggccgagtcgaagttgaagtccatttcgtcgctgtccatgaagtcgttgaggatgatggactcgacgtcgcactcgaggctcccgctgaacatgtcgaggtccaggtcggccgggaagcggtcgggcgcggcacccagcggcccggcggcggcggcggcgtacggcccgggcagcgcgtctagcaggaggccgccggggggtcccccgaagacggccgcgtgtcccggcggcgccagacccgtcgcgcccgcctcgccgggcagcgtcataaggctgatggggtgggctaaggcactgcgcgagggcgccggcggcgcgtacggggccacccctttgccagggtaggtgccggcagcgcccgccagcgccagctccccgggtgcaccaagcacggggccggccctgggcgcgggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgcacgcggataaaccgggtgtgcagagacaggttgtgccggatggagttctgtggccagagacaaggacaggggtggaggagtgggcagtgaggggataaatgatgggaagaggagtgggagaaaatcgaggagaggaggagagaaggcgaaaagaaacgccaagaagcagaaggggaggaaagagggaagatgaaagggtacagcggggaagaagggggaacaggtgtaagtaccaggtaggacaaactcagaatatccatcccccaccccagaaccgccccaccctccctgttcgcagcccgcacaggcactgtctgtaggatggggccggagctttgggtctagtcttgccagggaggctactcttgaggagccgcctgcagcaggggagcaagacccctctccccaactcagccaagctctgcccggggctagccaggctgctagggccccccaacagattatgtaagggctcatgccgctgcggctcatttgtccgccccccccccccccagcctggcgtggcgccaggagcccgaaaacccagggctccagaaatcaatctcgcggtgactgattaagccctgtttagaactaattgctctttcgtgtgtggggagaataaattacctgctttaatttcgtgtctttaaaatgcaactgcaggtagagaagactgttaaccctttgctggaagggtctggccaggataagcagaatcggctgggtgtccccaaggtgggcagaggcccacattttctccccaattctcggagcttctgcgaactccactccgatcccaggacacccctcaaagcacatccatcagccgtggagacctcaaaccccacagctgctcagtacccaccttcaggtcagcccagttcctttccctccccacccacctgatgcaaagtagctttgccctcaagccccttcctgcacaaaatccccacaaagcaggtgacatcatgcccatttacagacaagaagactgaggctcagagagatgaagtggcttgccttaggccacaaagctctcctgctgtgtctggtccttcctcgggcttcaccttagccacacctacacatatcttcttgtaaatttctgttgggctccatatcactgcctacttttgccaggcctggcctggggacagagggaggcaggggagtccacagctccactgacctggctcctcacagagaacatggaggactagaactactgcagagcctaccacgccccacctctggggcctccctgctggaggcctggactccctggctctggcactgttgtggaaatagcaggggtttgggtatctgaagggctgggcaggatgcctggctcttttcagccacctagctatgtgaccatggctgttgactcaatctctaggagtgcatacctcagtgagctgctctgaaaaaaatgggcaacatacagtaaccacctcggaaagctgttagatcattacctgagataatgtgcatgctaagtgtttggtgttcataaatgttggtcaaatccctcactctggccagaagacctcacttcttagatcactccacagacttactccttctctacaattcttaatatcaggccctgagtgtacctgcgctgggcacaaacaactctggggagctggcattaccccatctcctgtaccagggaatggaggcccagaggcatgatgtaacttgcccacggtcccacaggcaccactccaggtctgcccagcatacggacctgctctcatccccccagccccagaacctctgatccgtccaggctctccctgctgcctccttcccacctgactgcaggaggggtcctctctgctgcccagggcgcccacttgcccctcacccccagcaccaggcacgcacctgacttcttcagggccccaggctccttatctctggcactttctggtcttgggagacaacagctggggccccaaggcccctcccagcattgccctgcctggctcctcctggggccctgagaggaggggacccagacccccagggagtggtgctccctggagtagaaacccccctttcctgctcccgcccctgcacctggctccccagcccctccccaacacctgtgttcagggacctctgaggcctcagttctcaacccctgtgggactaactgcctagccagaggctccacctcgcagcccctccagctggaggtcagtcaggccacacctctttatccatgtcactatgtgccagcccggttctgagtgctggagggtgggaggagaaggaaggatgtcaccaagtagggcatctcctgagtacctgccgggtcagccctggtattgggagtattttatcccattctcagtactttatgatcattctgtcagtgttcatataactcagggactgtgacccctatctcaagatgttctagggaaatagcaacccactccagtattcctgcctggagaatcccacacacagaggagcctggcaggctacagtccatggggttgcagagttggacatgacttgatgactaaaccaccaaccatctcaaggtgaggtgactgagagagattacgtaagttgtcaagatcatacagttttaagtggcagagccaggcactgatttcaggttagactcactctgagtctaaaggacctcacattccaccatgggagagagaacaagtcagagaatttccaaagaatcttaggaaaccagtcctccatttcttctcaaactttccatgatgtaatcaaccctagaagctggtagcatgggaagctgggggcatgttaaaaggtcaaaattctctaagagtcttgcgtttcctttttagaattcaagggaatcttggcttgtattccacgagacttccaaattttctgaatatcaatacaaatgttttagatcaccgtcaagaacacacattccaggcctatgaaggtctctatccttccccactctgttccttgcccagccaggtacccctaagccccagcctgaaaccacagctggttggacccagagagaaaaaaggacttgccctgcatcacccaggacctggtggcagagctgggattcaagcccaggcctcctgacctgcagcttggtgctcctccctgtcctccagcaagcctgatctggggccactccctcttcctctctgggcctgtttccctccccagaaattgatgagatgggccatgcactctaggcacctttgcagttgacaacgaaaagttcttggaattgttcaggccaggggttttcaaacttttttaagtagtggaactcttgtagtaaatggaatctaacacaaaacatgagtgttccgcactcaagccactggggctggggtgggggtaacctggaaccttttctgctcagcaccctcccttggcactctcacagaaaatggcccttggcgaggaattctgcaggccacctggatggggttgacgcttagtaaggtgccattctttgcccaaggtcacccagggaggtggcccagagctaggtgaggacttaggccttggtctgctgagcagggctcttcaccaggtgtgcaccagggctgtgccccaggaggccaggccaggccctgcagctcattctggctcctcagggcccagccacctggtacccatcagagctcccggccaagatcctgtggcaagcactgatcacatctcacccacacaaggcctcctgggaggccagaggccacggaggaggtgagggagggggggcagggagacgcctctgccaggtagcagtaaccagggttccctctcagagttgcctagcaacccgccaccacagccaaggccccggcatgcccaggctcccctggtgcccaagctgggcttctggggcctcacacctcccacaccttcatgcaggcctggtgcagtttccaggatgggacctccctgacttggtgcctcagcgagactatcgggggtgggggcagagggaagggacagggggttacatcccagcccctcctactgtcctgcagaacctgggtgagaggccagcctgctggggcctcagtcaccagggcgaggaggctggtgcaggacaaagagcagggctctggtgttggatccagattccagtcgtggctctgacacccacaagcagttgagctgcatgctttgaacctccagttcctcaaacaggctacctgcctccacccttgtttcccttgagccttccaccaggcagcagccggagggatcctataaataacccagatcacggtccagtcctgcccagaacactcatatgcccccatctcactcagagtaaagaacaaaggccttaccatagcccaccagcccctctgtgacctcctaggctcctctcctgacactgtcctgcttgatccctcccattcttcaaaccttccaggaacctgccaggtaccatcccaccttgcccagatgcccatgtccatctctcagctcaacaaagtctctgttgagatgccacctgcgcaatgagacctatcctgtccgctcttaacagatgttcctctgccttgccgtttcttggctccctaaccctgctctgagtttttctaaaacaattagcactttctaaagtactgtataatttctttatattatgttcattaatttgttatctgggttcccttattttagaatccaagttccatgaagcatttctgtccctttctttttcttaccagaccccatgtgtttggtgtatgccaggcgtttcataaatgtttgttgagtgaatgaatgagagacagcaaaggagggtaacatagtcttgcagggagaattaatgagattggcagagtgacttgcacagaataggggctgctccaaactgagagaacacaggacagaatgggaggcaagcaggggtagagaaggcaggagcatcctgggccacagaaggaagcacagagaggaggaagggcttcggtgagagggaaagtagggctcccagggtgaacaaggcagctgcccaccctggccccctacctgctcgctcctgctgcccgaacagatctgggtaacccagggcttgctgcggccaaggtctctagcagcctggaccatctgagccagaagatgctccaggagcccccaggggaacagaataacctcgtccttgctgatggtgcctcccccatggacagggtctgagctgtttggtggcggcagctcatccatccaacgggacaccctcatctattcccaggacacccttcgcccacgagcagtaatgcattcatctgacaacacaaccccatttatccagcacaccagtcccatttatccagcaagtacaacctcatttgctaacagcactccattcacctgacgggccccctcatttatccagcaggacaccctcatttatcctccaagtcggaggctctccttcctcctgtggtgtggctgtgttctctgatggtgcaacccgcctgatccagcaggacgtcatctctcctacaagtacacttcatcccctgatactgcaacctcatttatctaataatgcagcctcaccttgcctccaagtaccacctcattccttgacagtacaacctcgtttatcttccagctcaacctcatttctcctcccagcacagcttcattccctgatagctcaacctcatccaatcttacttctccagccagagcccagcagatctcagggctggggagtgggggggaaagaggaggggtttggagcaagaagaagggtcccaccatttgctgtccctggcctatggagggctgcctggcactatgactatatccaatcttcccaggcccctggactttgagttctaggttgcatggtccagccagtgctccaccattgccccccacctcctgtttggtccccttgatggctaaagagaatccacaggatggatttttttttcccagctctccagcaaggaaaaaactccacctgattagatttgtagcatttgctggtttctgtggcatgaatattcccatcgtagccaattttaagctggcagcatgatgtcactgagcgcagaactgggaagaagttctccctgatcagctctcacgagccagtgcaagcccactctcacacaccactggcacacactcacataccaaggcgggagaagggcaccacctaccacgtgccagacctaagctaggttcttcagatacatttcttctgtgaattctaaaagccatccaaactgtggattcagttcagttcaggcactcagtcatgccgactctttgcaaccccatgaatcgcagcgcgccaggcctccctgtccatcaccaactcccggaattcactcagactcacatccatcgggtcggtgatgccatccagccatctcatcctgtcattcccttctcctcctgcccccaatccctcccagcatcagagtcctttccaatgagtcaactcttcgcatgaagtggccaaagtattggagtttcagctttagcatcattccttccaaataacacccaggactgagctcctttagaatggactggttggatctctttgcagtccaagggactctcaagagtctttctccaacaccactgtggataggtaatgctattttatgaagtgggggtggagaggggaactaaggctcaagtaggttaaatgactcctgagaccacaaagctgggaagtgatggagctaggtctgggtctcagggctcttgtattccaaagccaaggttcttctcactcacatccctaatgaggtggggaacgctgccctgctacccacctcagtggccatccctgccttgattctcaagcccaagcttcctggctttcatcagagacaggagacccaagtgttacgctgcccacccataacaagccctgtgctaccccctggcctctagtaccgaggggatcccaggactctcccagttcagtcccggatcttgtgtccatccatccaacctaaaaccaggtatggttgcctctccaggttccattgctgtccaaggttctgcctggccctgccctcaggaagctggccccacctacccaatggggatgtgacccagctcctccctttggtgcctcccagagcagagatcacctgtggggctgcatgagtgctctgattccctctgtgactcctgtttcctctctccttccttccttccctcccttcctgcatgaagaaatactgagggctagaattggaatcccagcctcatccatgtgaccttgagcatctcctgtaaaagacagtaactatcccaacatccatgggaaagggagtgaggccgggaagggcatgacatcccacatcttatgatcttatggagtccctatctcaggcccaggagcaacccttgtaccaccctaaatcccccacccacctctgacccaggaacacacctgactcagagagagtcacaaaaccgggggttgggggtggggaatctaggtaaggaggagggtcacttgctctgctgcttggagtactcagtccagacagacttcctgggagaaggagtgacctagatgacctcagggccctgaggccacatgcaaacccttggtactagggtctgcagggaaggaggggtggaagtgcaggcaggagcatcagagccacaggtgttgacaggtgaatggcttggagtcattagtggaacagaagtgggcagccaggggccaggaggaaccaaatagccaaagcaaggcaggaggtcaagagacaggccctggcatcccccacccctgccaccccagagacaacagagcccacacactcagcctggacagcaaacaagccaacagcagaagtcccagctcacccctactcaaagacccagggctcctcatcctccagactgacaatcaagggcctctgatgctctccagcctcgtcacctccattgcttacacccacctggaactccagccaccctggatatctcacatttcctgcctttgcacactgttccctgtgcccttctctctttctctgtgcacctgggtcctgctctatcaaggcgagctttgtggtgtctttcccctctgcaagcccccaaaataactattccctccccatttctactgaaaaaatctacctgtgcactagagtgtaattgtggatgagtctgcctcccaacttgaactttgtgggcaatccttggctcacggtaagtcaatacatagattggaacttcacggtaagtcaatacatagattggaactttcagcagccatgaaccactcaggcctggcaactttgccatttctgttccgccaaacctcaggctgaagttccaggtattggctcctcctcctcctggtttttcctccagttcctggtgcctctgccacctccctactctctgctgactcctccggagacttcaacaagtggagaaggaaagacactacgatttgctgagcattcacacacacgctggcactcaacagtttaagtcttactgagtatctgtaacaaacctctgagttagtttattattctgattttacagaggagaaactgaggcttcagggaacaattgacctgctccagggataagtgttgcggcaggaattcacaccagggtctgtgctcttccgcctaccctgagacacctctaggcgagcctaggccagacagaaactctcctggggaaagggtgccaggaactgccacgctggctcagcaacccctgcacagatctcctctctcttccaggattaaaggggatccccagttgccaagccattcaggcccctccgagcccctcctcattctgatcccctccctcactctgctggcagcacctcccacacccctgccccaggccttgggagcagctgcagtgacctcacccggccctgccctgagcccagctctggggagggcttagcagctgtgccccagccctgcaggcggctggggggcagggggtggaaaggaagagtgggcatggtgccaagagaaccatctgctctcccaggggcatggccacccgcacagacactggcctcacccccaggggctgcccttggccctctgtccccatgccaaggggctccaggaggcctgagcagcccacccagactggggcagcagccctcatctgccatctgtcttctcccggagcctgagaggtccttgcagggcacattggagcatgaatgtccgctggaaaatgaacaagtgcttggggtaagttctagggggcagaggccagaggccagggctgggtgtgctgagcgctgcccgcccagccccagtcttgtcaagccaagagcaggcaatcccctgggggatgagggcctccatcccctcacatctgctcagctggcaggtgccgctggcagagggcaagccccttcccccacagccccagctcaggttacaaaaggaggcaaggccagctgaggacagggggaggggacaggaggggtggaggaggcctcacagcttcccagggtattgggggaggggagcttggatccctagatgggacttagagccagagagggaaggaccatgcccaaggtcacacagcctgccagtgggcaaagaggagccagcatctaggggcaggcagtgctgagttcaagggtaaccttgggtaaatcactgccctcatttgtaaaagcacagggcctgaaacctgcctgcttgccctcaaggcctcagggaaagctctgtaggctagagagcagcatatggaacctcctgattccctcacaccccagggacagaaagggagggactagaagaagtcttgcccccacccccaacacacacaagtcagtgtctctcagggatcagggcccaggacccccaccctacccagggcatagacagtcatctcctttcctttgccagagcgatgaacaacaataacagtatttgctcagatttcactggggactttacatttaactctcctcagatgtaattctcacagcaaagtttggacatgtcttatcatctcattttgcagaaggggaaactgaggcttggatgctcaaggctacacagggtgagtggcaaaactaggactgctcctccctgcttgcctcaagactcttacccgcactctgtcttacctctgagatcctcgacgcaccaaagggtgctgcctggcacttcaggcctgggatcttggggcctctactctttctcagattcatcttctatcctggatcgcagtatgaagtccacagtggcccctgagccagtctcttcccctgccccaaccctccataccatcctttctgcccatgtcatccctcatcccccacagcttggagtgccaacttcttggtgtggcattcaaggccactcactcaccagccagcccctgcttgcttctccagcctcaagtgctgctgggctctggctaacatagctagaccctgtgaggctcccaaagaatcctgactgagggtttaacttttttgcctcattctcttccctcacctacaaatacccacagcgaattatctgtccctccatcatgaccctgggtcatttttatcctcatcttatttccccagctggacctgcaggcattttgagggcacagagccagtccagttcctctgagcagcgctgcacagtgggtgcccagtgggtgtaggcctggattaaagtgagtggaggaagcagccatcagccccggggcctgcagatggagagggggccgatgtcagctccctccctctgggagctctgggttgcagaaagggagtcaggatcccagagccaacccccaggctggaagcctcagggccaaactccaagggaaatcagagagacaatgttgcgggtggaggccagcctgcactagcctggacagagcactgggttagggaggaatggcccatgggagtttcatctctgtcactgccagtgggatactatgagagcctactttgtgtctctcagcctcactttcctcatttgcaaactggggacagtagcggtaccagcttcacagtttgctatgaaaattaaatgggagcacgcctgtcacggcccatggtggctgcatctccagctggaagagttctgtgtgtggctgaagcaaaggtcagaagacagggctgagtgatgtggctcgagaggttgactggggccaggaggccaagacctggagtggctaaggccccagaactggtccctgtaagaacagcacacgtggtctcacctcccccaccagacagggagctagcagagagcagggactgcgactttccggttcctcacgggccagcgccaaagaggtctgccgaggattcacgccatgaccgttcccctccctcctgcagccaaacgctctgtggcggagcacaggagacacggagggcagaaggcgggtgaatggattctggggggtggggggtggtgggagtggtttcagtcccttgaagctgactgcatggggctcaactcctggaggacccagaaagagtgaggaagagaggtgtgggctcaatctgggcagcctgcttggaggagaaggtggtccaccctgggaacagaagacaggagggacaagcaggagtcaaggaagataccatcgaaggcatcagttcagaatctgacctgtcaccagacggacctgttaaaatacagatttcaaagctcacccgctgacagtctgataagagggtctgagacggggctgcagactgtactataaaagcttgtaggtgactcagatcaccagccagctctgccaacacctaaggacttaaggcaggattctcagaaagacacattgggtttcagaatcacctagtaggtaggtttttgttcaaactacccaagcacctgcctagtttctgaagggtgtccccagggatcagcccctgagagtcgacagcagtcttggcgagcagttgacaatggcagtggtctgggttggcaactccagtgtcaggtataaagatggcagtgtgagggcagtgtgggatcgatcagaggcagcaggggcaaacaggagagagggcggggcctggacacggccagcagagggcccaggggcccgatcagagcagtttgggcttggttggctcccaagggaactgagtagccctggagggttctggagtgagcatgagtgagccctggggcaggaggactcattgggatgtgggctgacactgcaccggcattgggagatggtgacacatggtagaaacagacaggtctgcatctgaacccaggctcagcctcgtttcagctgtgctgccttggcaagagacttgccttagaagagacttcgtcttttcctcaatttcctcagctgcaaaatggggctattatcacatacctggcaggacccagggaggatgaaatgggaagatttatgtgaagtgcccaactgactgcctagcacccgggagttaattctcttaattcttgttccccttcccacaagaggcacccctcttagagaccagaaaggtttctctgcaaagacggaggccctgggtggggggagggcccgctctnnnnnnnnnnnnnnnnnnnnnnnnnnnnnnnnnnnnnnnnnnnnnnnnnncctcccccacaagccacctggcccccctcccacctccacatatgggttggggggtggggagaggcagcaaacagccaaaccctcccaaacaggagttggtttccatggtaacgagggtaccaggaggaaggggggcgctccagatccagctgtcccccctgagcgccctacccgggccccagagcctctgctgatgcccacctaacaccctggacccccatctgcctgctctggggggacagctgggaccgccacgagcactcccttcactgtgctcagagtacgtctgccacctgggtaccgccaggggcagggtaggcagccccaagcaggagcccccagttcaagtccatccacactgctactcactgcgtccagccacgagaagccccatcagtactctgcgcccccaggcccaactacccatcatggctcttagaacgagagggtttatccagttacagctcccaaaagggccagagactgggtgagttaaggccctttggctatggatgagaacacagaggaccagaacaggagagagctttgctccagttcaacacactcgagatgacggtcctctacaggggctgtccccacccctcacccactcccaactccacagctccaacagaccctgaggggctgagctagggcacctggcacaatgctccagagagatgggccatggccagagagaaggaagaaaggcctaaccacccaaaggcctgtctagtgacagaatgggcagtgctggaggctgcaagctcccagcacctcggagtgtgtgagaaagggagtaatctaggaaggagccttgacagcaggtgatgggctccatgactccccaactctcctggagacggaagtcagacttggacgtgataggaggaggcaccaacgtgaacctgtttctcggggacacatccacaagatggtaggcaggccacaggctcagatagggaaggggtgctgaggagtcagctgcgaggtaagggagacagtggcggcggggcgggggcggggggcggggctctccctgctacagccataccctagaagccctcaccgaagccttcgactacacctgcactcctcacaagacacagaggggcttccaaagctctttggaccccatttagcggccaccaccagccaccactcaaaagataagagaaggtgggctgctagaaacaagcttgccccctttccaatccctccccaccccagccctaatggcacaggaggaaacacatgagtttggggtgtataagggggttcagttctcaggtctgccagttcttagggaggtgatcctaagacaagtcttctccacctgggaaagtgggatgctaataccagcctggaccggtgggcgcttgctccccagccctctgagcccttccccttctctggcagagcccctccactccactcagttctgaagctgggttctcagggcctgcagacaggggagccccaacccgcagaaagtgggggctggggggggcactgaactttcgaacctgcacacccccctccccgcgccgttcattaccttaacaggagttaaaaataaccgtctcatctctttaaattagtctgtctgcaattaccgcctggcacggcgctgcccgccatcgtcccgctggagcggcgccaggtggcaggcgggggccctcaccctgtctgtcagtctgtctgtctgcctccgggtccgcccctccttctcccctcagaggtgcagctaccccaggggcctcctggcggccctgcctctcgagctccccaagttgctggggaggggcggcccggggggccacgcacacggctggcagaactgagggggccttcgttgaacagaggactgggaggggatgggggcgggggcgggggggcgcggtagcgggggaggggcgccgggaggcccgggaagccggaagggcccgccgcgcgccagcgctcgtgggtgggtgtgagcaggtggccgtgggagtctgccgggcgtgccagcaactgtgccaggagcggctggcacgggctcgtgcccaggaggcgggcagctgccagccccccgctcgtgcagcgcggggggtgaggacaccccccaacccgggctcacaccgcctcctcccacacccccaccagccctcggggctggggatccccggaggacaaaggaggaggagggagccctgctggaacgggctgcggggaggagagaagggggagctctgcaagcaaaccactgctcagccgggctgtcgcaggaccctcctcctggcctcagggagcagcccctcccttctataccccaccccacctaggacctactggccagcctgggcgggatggggggtagggcaccacccctcctgatcccaccccacaacagccaagctgctccaggcactgagggagaagggaagtccccctccacggggctcctccccacccatcctggggacagcaatgggaggcacccaggtctggcctgaaagctcccaggggagctggcagccaggaaacacaaaagcaggcagaacaactccaggggtgctaagtggaaggagcaccaagatccagagtagcctggaaggcttcctggaggagtccagcactagggaaggaggggctagagtgtcagaggaagtgggagaccctacttggatggtaagggacagggaggcctggcacgctacagtccatgggggtagcaaagagtggacatgacttagcgactgaacaacaataacaacctggatgtgggacagccacacttccggaccctgtagagggagggagacttcctgtccaagccctcggccccggacctggagaccctatgccctgatggcaactcttccagcctctccggcaccaagcccagtctctcttcgggcttcagcctgctgggtgccttgcgcctgctgatgatcttgcctcctccaattcctctctgcaacacctctgaactgtcatcccacatccctggttgggccacagggcaaaagtcaagcccttcctgatctggcccactcggcctttcccatgacacagccctgccccctccaggagcccttagttccagcctggcacgcccaacagtctcccaaacccagcgtatgaattccacctccctgtctttgcatacacagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttggaagtctttcccccaattctacccgccttccccacccagtgaagacagaccagactgccacccagtgaagacagaccagatagagtgccatattctctgggagggcttgcctggctccccaggggatctccctgctttcaccacacccctgtcccccagccctgtcccccccagtccccaccccccagcccttcctgcctgtaaaacgcagggcttgggtagccgtgatgcatcctgaaggtaggtccaatgcctcccccactggtccccccactctatctatcacagggttcagtacacggcaggggctgaagggcaacacttatgtgggggaggggagggaagaaggaacaatgggtccctggccccaaccctggcacctgaggtgtcccataggctctgtaaccagagggtggctgggagttgggaatggcccctccacccagcccctggagggactgactgggaatgggggaacaggtggtgggaggggcgggaatgagaggggaaagaggctccctggggagctggatgcaggtgggatagaaggaggacagccattgaggggatgagacgggaaaggccagaggtctttctgaacagccctcctccgctgctgcgggggtctctgccagggtctaggtgaggagcccaagcctgaggacccctcaccaatgccccagcccagggcaagccttcctgagcccaggcacagggagaagcagtgtgtccccagcagtgtggtgcagaggaacccgcatccaacgggcaggcgggaggcctgggccatcatccagggcctgccgctcactgatgacctaagaagagtcccattccctgccagggcctcagtctaacagtctgcaaaatgaactcatgggactatattatctccaagtaccttcccaatcccattctcagatttagatccatccctgtttgaaagttgccagtgtccccctgccacacccagggcaagcaggacactattccagaggctctgggtccctggagggagacacacagagattggaatccagctttcccatctactgactgtgaccttgggcagtttgcttctccactctgtgcctcagggcccagttctgtaagtagtgacagtaaaacccacctcaggcagtgcagagggcattaaaggtgacacctggcgcagatgcctaaagctgcctggcagagggcttggccctgagaccctcagtgcactgtagttttttcccaggttcaagcctcatgttccctcttgccatcttccccatcatccctaacccttcaactccaattggagctccgcctcctgcaggaagccctcctggcttgctctgactcacagtatcctccctggtctcagcaccctctgcactatccactcactcctttactcttttaccagacatgcactggtagctcctggtgccaggctctatgcttggtgccatgggcacagagattgatctaaccactgccactgttttccaaagagggtggggaagggaaatgagacaggacacaaaagactaagacttatgacaggtagggagaggacctgagctagcgaaaaggggttaggaaaggcttcctggaagaggtgtctgaactctgcccttgaggacaggaattatccacaaggagaagcggagggtgggacagtgcaggggagggaggtgggagcaaagcacaggacccacttaggaggaacaagtgttctgctgggggctgagcccagggggaccagctagaggatggagagaaagactcaggcctgctactccagcctgcgtccccaccccgtagtggccagagagacagaggagctgccagcataaaggctgagagccatgggctcccaggtcaactcccaggtcaacacagccaccgggcatctcgtgctgttcatgtccacaagcctcccctcctccactggcacacctccttcccctgacactgcctaccaccaccagccacagcccttgccctccatttaggcatgtctccctcatagagaccccctcttccacagggagcctgacagcttacaggccctaggcatggcctgaccacccctaccccccagcctcctctcctccaaaggcattgactatatccattccccaacaagttagccaggggaggatctggaggccacaatccagtcaagaccccgtcctctcccaagatggctcccccctttccagtggttggtactgaggcctccctggggtgcccctcccccttcccccacccccaaatgcatctgggctcagaaaatcagggaagtgggagacagacagcctggggtgggcacagacagatccccaggtctcaacaccctgccctcacaccagcaggggtcatcaccagcccaccatgctgatccaggcaagggggggacagcagctgccccatggagaactcagatcacctgaccagttccccaccttagactggctggtgccctagggtgaactcctggcactacagaaagaactgtgggcctagggtcgcattcctcaccctgaggccagcttcagggagggcagtgggaaagatttgggaggaaagcagccaccggcccggtcattatttcagctctttaaggagggtgccctggtggagagggtaaaacaagagtaacagaaagcaaactcgggaggtaacagaggggtccccagtgtctgaggcctgagaataggctcttctgctatgcccccaaggatggggtgagggtatccctcgggggtgcctcaaagtggcagtcccttgtcaccctaccagacctcccaccctgcatccagagcatgcacacagctgctcccagcacgcccccgcctgtctgccggccggccccacgccctgggcacacactctgtgacccctgggggtgccccagggtttccctccagaccaactaccgggtgcccagggacatctagcagcccttggaagccccagccaacggctctagcacccctcccagccggacgcccccaccttccagccggccgagctgttgctgtcgcctttatccttgaagtagggcacgtaacggaccatccagtcgtagatctgcgagagcgtgagccgcttgtccggggcgctctcgatggctttggtgatgaggtcggcgtaggacaggttcccccacgcgttccgccgagagctcttcgctttccgcagcggtccgacctccgcgcccagcggcggcgctggggccatcggcggggccgtggcccggcgctccggcccgcagtcctcggcgctctcggccacccccgaacccagcgctccgtcctcgtcgccgaccaagtcgggctgcggcaggggccaggtacacgagcgcggccggctctgcggcgcgaagtccgggtccacgtccacctgatgcgctcgcagcttcgcagccatggtcccgcccggcttgggcgaggaggggaggggggctccgcggagggtgggcgggcggctccgggatctgcgcgccccggggaggcccgcgggaggggtccctggcggcgccggctcaaccgcggggcgccatgggccaggtcgcggagacagggggctggacgcgctgaaaagcccgaagggaggaaaagaggggggcagtgagagagcggcggccccggagcccaacgggcacacacctcgccagccccgcttctagcacctgccgcctgcttgtgcctgcagccaccannnnnnnnnnnnnnnnnnnnnnnnnnnnnnnnnnnnnnnnnnnnnnnnnncctgcgggctggaggcggaggcgcggggctcccggccgggggcgaccccgccgcagcccctgcatgcaacagcgccgcctacggagcagggaagacaaggcaggcgcgaccccgccccctgctttgctctaggggagggggcgcgggggcggggcccgggcactctcattggtccgaagcagggctgtcccgcccacggactcggctggatccctcccctgagcgcgtcagcgggttattgttacaacccggggtttcccggggcaacagggatgaggcggggctcagagcacatggccccgccttctattcccgggaggaatgccccgccctctgtttctagacccttggtatttccaaatcttcgttccagaaacctggtggggtggatgatggagttcttctgttctttgtgccccgggctggggaaaaggagagggtcaagaacacctgggttctgggtcaggcttggccacaattttggcttctccatctgcaagttgtttttcgtaggcattcagagtgcctggtttaacgtgtagtagaatcaacctggagagcttgttgaaacgttttactgggccccagccagattactgggttgcggcttgagactttgcatttctgacaaggtcccaggtgatgcacccgggaccacactttgcaaaccactcttttagagtctgttgcaggctgttgccagggttgttggaacaaacacttgcctcaaatttcatcctgtttggggagaagtttctcgttcacttactatatttattgagcacctttgatgcatgtgcactgttccagctactaaggcgagagcagcaatggagacagatgaggtctctacagcataggctgtgaagaagtcaggtgttgtcagatcactgtatggcctcagtagtagagaggccagccgagcaattgggcagcccatgatctcatcccacagggccctaggctaggtttccagccaacactccacctgccagcctttgctttgtgtatcccctctgcctaaaacaccctttcccccactcagaggctgtcattagagattctcccatccctcaaaactcagcttaactcatccctgatctcttctttaacccaactcccagcactgtccttgtccattgcttgcgcagatcactgtcttctctgccagtaatttctgtgtccctctaggacaatatttctcttttgccaatcaggaaactgaggtccagagtgggcaagtgaattgcccagatggaatggccaggattagactcagactcaccagccagtaccacattcctggagaggctggacactgcaacttgcagaaagttctctgtgcaggactgggcccaggccacaggagacagccctctccaaaattccttcctttcagcctaggtcccaaggagtagggccaagggtgaggatgggggtggggccggagaggcccctccttgccaaccacccccccactgccgagggtgggagcaggtccagcttgcaaatgcctggcgtggcatctgcctgagtcacattccgaaggcaagggtgggcatggaaaccattggctgcccctcttctgcttacgtatacacaccctccaggtggttcagtttagagacacaagggccctgaaatcattgctggactccctcccacagttctcatatgccctccgtgcccatgctggaggctgccccctcaagttccctggaagccaggcaggcctcctgctagtcttcagctctggcttagcctgctctgtgagatggggcctgctgggggccataccagagcagggaggatccttagctgggggccctggcacaggctgctgcgggactgggaagccaggttggcagagatgccctaaaggctgactcaggctctgctctggcccctgccctacccagtgtctacagcttctgcctggactctagtctgggtcccacactgggcacactcagcccccactttacatagacacacacattccccaccatgtacacagacactcacttttctctactcacaacttggttcctgctcatatgttcattgtgaggcagtctaacattaatgattaaagtatggacaagttccttaactgcccaaatccactatttcctaatctataaatgagtaacatcatagcacaagttcagaggctatttggagaattcaataaaatcatgaatgtcagcatcaggctcatagtaagtgctcaataatcctagcatttttttattactgtaggtgttaccttccctccgtttgtcccaggtcacattgtcccacctgctgtcgccacacacatgatggtgtccattcacacactcgggcttgctcgcaggcacacctgtctatgtccctcatacatgtgtcccaattacatagaccctcaagttcctgtggtcccaaccccaggactctcgtccactcccttcccctcccccacacctgccctcaagctcccaattaccctcgctgctactcccacattcatttctgctcacagacaagcccctacttgctcaccctcgctctcctcccccttccacacacaggcacgtttgcttctgctcaaaccttcccttggacttaacacacttgcattccagtgcacacacactcaggcacactcagacacctgctttaccgggtcagctcgtacttggatcacaaaacttgtgtacatacatacatacaccagacaatcccagggcatgtctcgtacctcagcgggtccatccctcccagcgatgagcacgtactacccagctctcctaaggcacactgcccttggcagatcccttctcaggccacacagtgacactactgtcacccccgacaggactgtgtcttcccagctgcttcccctcctccagtctcactccccatgccctcccagctctcagaatagcccctgcgtctgtggccaccgccacctccaccgctgccactgctgagctgtcaggacccgccggagcctgcttccccagcgcagtgccagctgtcccggctcactcggggcaagtgaggacagaagggcaggctttgctgaggtctgacgggcatagctgctctgcacccctggaaacctccttccagaacccacctagaagacagtcagctctctggaacccactgccactcgcccagcacattcccagtccctgaaggattttgcctgtgtccctttttatcctcaagagcccagagaggactgcctccccttcgtggctcagagaagctgaggtctggggaggaaggagtttggtcaaggcagagcagagagtcgggagcagagccaggccaggaccagcccttcctagcctttcctgggggatccctccttaaccacacagttatcaagaactgcccccctgtccccgcctgctgatgctgagcagagcctggtcgacatctgatgccacagttgtcaggaaaagagaataacacaggggtgatgtctggggatgcctctggagggggaggggctggtgcccagctgaggcctccaggggtggaagagggagagtctgtaggagccagaggggacatcaggacagctgggagagcctccagggcaggctcgggcctggcccaggaccacgtcagagagtgggtggggctgagctgaggctgtgtggctgaggggggcagcgcagcagggcagggctttgtgacaagaccacggctcctgcagttgcctccacagtgccggcctgggacagagagtcctgctggctttagggaggtgacttagaccagctcaatgcccccaaacatgagcctccaaccaagagaaccttgtgtcctcctgggccagggagctggaccaccaccaacagtggcagagaaatagtgctgaagtgaagaactcttgtaggtcaaacctgtcccacccaccatcccccttcaatcctgtatccttatccccatcaatttttttaatttatttttttattgaaggataattgctttatagaattttgttgttttctgtcaaacctcaacatgaatcatccataggtgtgtatatatatatatatatataatggcatccgttcagtgccagcccctgcagagaccctgccaagcatgataatccttgggggcaagaactctgcctatcttgttcgcagctatacccccaggacccagagcaggggctggcacagagacgttcaataagcatttgttggatgacagaataaactcattttgttctcacaagcacctgagaggcagacactgtcactcccattttctagatgaagaaaatgaagctcagagaagggaagtgagtagcctgctttcctggaactcaaactggagcctgggtttgctcctcgccaagcactagagacaggggaaaactgagctttgaggccaatcgtttcccttctctgagcctcactttcctcatctgtgaaatgggactatatttacatgttggggatgattaagtccatctgtgtaaagtcaaatgtcagacaaatgtatgctcctttcatccttctcctccttgagttagccctgatagtctaaacttccacacagccacacctgggacacatgaggattgcaagtctcccttctttctgtacaacaggaaggaggtgtatttgtctgctggggctgctgcaacaaagtgccgaagcggcttaaaagaacaggaatttattgtctcacagctctggagactagcagtctgaaatcaagatgctggcagggccacactctctctgaaggctctgggggtgagtccttcttcgcctcttcctgcttctggggcttgccggtgatcctggcagtccttgtcatatagacacatcactccactctctccctctgtcttcacacagcagtctttcccgtcccttctccctgtcttcacatggcgttatcctctctgggtctgtctcctccttatgatgacaccagccacactggatttagggtccaccctactccactatgacctaatcttaactaattgcatctgcaaagactttgtttcaaaaaaaaaaaaaaaaaaaatccaaagctaaggtttcaggaagagcgtaaactttgggggtggggaacactattcaacccactacaagaggtgtactagaaaaggtggggggtttggggacctgcaggaagggcttcagattctgcctctttcaccaggaggctggactgtagactgctctgagtctggactgtagactgcactgagtcttgtttcttaccatgtagagtgacgacagcaactctgacctcccagggatgttgaaaggaaaagatgaagtggggcttgacagcagtgccgggcagaagaccccagcatctcactgtggcctcacggcccgggctggccctcctgcccacgtggccttcctcgggattgtcctggcttggcctgtcatcttcctgacccagtgatccgagcagatcactggacgacagtgttctgctcctcactgctctgttcctcagagcctctgttttctgatcaaacaggtgagaggcctgcatcagatgatctcgaaggttccattgcaagccaacattcacagtgccttgatatctcctcacaaaatgctaaagtcgtctggaattctgtagagccatggctggtcagagaaggagtcctagggaaaggaatgaggtttctaggaccttccagctgccccctctcaccaggtcccccgaggcccatcaggccatgaaggcagcagacttcccaagccagtgagcctctgcctgtgaggagcccacagacattcacccagagccccctgggttggctgcttctgacctcggcagcagccccagccccagccctggaggacagggagctgtggacacagcagtgaatgccagctccatcatggactccctaggggacctgggcctggtaccatacctcagtttccccgcctgcaaaatggagatgcacctaccaccagagtgggcaggagaatgaaagatgacatggagaaggagctgcgtaacctccggggcattgtaaggaaatctatccctgtggccttcagcatggccttgccctctgtctcctgggcccatcactgcctccccagccttattctcagacttaggcccctctggaatgaagcatgctgggaagaaaggccatggactcccagcaagttagaagagtgacagcaaccagccccactgatgtgccagctaataggaggaggggggaggctaagtaacagaaggcctcctgtgtgccaggcactgggccgtatgcacctgctcatttcatcctgatggcctcactctggagccattggtgctattcccattttacagatggggacactgagggcatctgctgaggaaattgaggcagtatctgctggagaaaacttatggggttgttgtgagtatgataacaataataatatttaataaacatcaccctcatcatcaccatcattattatcaagtgcttccttatcttacttatttatcaagtatagcctctatgctaattgattccatggttctctcttgatccttaaattaatcctaagaggttggcattattttagggggggcagcagaggctcagagacgtcaactaacttcccccaggtcacagagcaaagagccaagccagagttttccagccccaaagctgatgctttccccactgcaactgttttctctcacctggttgctgcctgcataggtgagtgatgtcacatgggtggtacagactgcccaagccaagtgtggccaacacggcagcagatgggataggccatcatctgcatccatgttttgtgaaacgtgttcagtccacactcttaatttctacttattttttggccatactccatgtagcatgtgggatcttatttccctgatgaaggatcaaaccctatgccccatgtaacagaagtcttaaccactggatcaccaggaaaatcctttaatttttactttttaatcattgtaatgtgatacttagataagagtaagtgagaacaagtcaaaaatgtggtccctgcaaatgataaagctttcctaagctctcatcacccagcttccatgagatggcccctttaggtggcctggccgtcccatgcccagcaccctgggatctgggttcagccccagtctgccttgcaactttgtctccactggtcctctgggg

SEQ ID NO: 46 - DNA, 75831 bp, Bos taurus
  unsure (332)..(383): sequence unknown
  misc_feature (333)..(382): n is a, c, g, or t
  unsure (55059)..(55110): sequence unknown
  misc_feature (55060)..(55109): n is a, c, g, or t
  unsure (60703)..(60754): sequence unknown
  misc_feature (60704)..(60753): n is a, c, g, or t
cctgtgggctggcctagcagtatcctcagccagaaggacatcctcagcacccactcccatgctagttcatgggctgggtccctgctctcatcccagcatttgaaatggtcagtaatcctgtcaccagctcctgggcccagggttaaatcagaaaaacttttgcatatgacttgtcttttaatctccttttgtttttttaaccagcatctcacttcctcattataccctctgtccgctcacagcccctcacccaccctacccggctcctctgtacatcgtgcacggcggccgtggctgcacccctgacctgagcacgcgggcagagtgatgtcnnnnnnnnnnnnnnnnnnnnnnnnnnnnnnnnnnnnnnnnnnnnnnnnnntccctcctccccctcccccctgcccaccttcccctccctcccctggcccccttgcccgccctccccctcctttctgtcctccttgcctctgctccccctccccttctccttcctcaccctcttcctcaccctcttctccagtcttcccaaatacaaagagacaaaggctaagttcacggaacgatggcacccacgcccctccttcttacagcacgcgcctggagccagagcacttgagcattgctgactgtcacgcaggtagagcacccggcacccggtgggtgctcagtgaatgtatggtggttacattaatacacgagtattatagtcaacatcgattgagcatccacctgtcaggcatactctagacacgtgccgtggttatcttggcaaaccctcacaatgacgcagtgaggtacatacttttatatgctccacacccacactcacacctccacactctggacatgggcttggtgctcaggtcttttagagctaggggctttcaagagacccaaagccaggcagacctgacagccccctatcacctctcaatcccaccccacgtcccagcaccacaccccagcctcagtcccccagtagcaagagtagagccatattagggccagtttctgtgaacacaaggcagagtggaaggtgagtccaagtcagcatgtctggccgggccctgtcgggcctcagcatccaagaaggaggccagagcagctcttgggggtagataagcaaccagagatattcttctgcagtgagcaaacctttggccagatcccctaaaatcagggtcaagagagtgtgaaaaagcgaggtgtgtgttcctgtgtcttgtttctttctgtttatctgatttgggaatgtatgtgcagtcttaaaaacaagttagatcatatttccttttaggtgaaatgaatcagctttattgaacagaatacactgaactcagagctgtggcctccaaaatgagaatgtggggttactgagttgatcaagaaagcacgtcaagccatttacagatgtcttattaagtcctcataactgtggtagaaactggtgtcactcctttttaaactgaagacatttattaaagctcaaacaggttatggaagttgtctgaggtcaggcaaaaaccactccatgtggctccatgccactccagtgcctggggggctggacaggggagctgcacccaagcccagagccctgcctgggtgggaggcagggtgtgttcactagcaccgcaccaggggtccactgggcaagttcagcttcattttcccagtgaggccgaaaatgatgaccagatgaccttgtttgagaatgcctgaaatcagtgcagtcgttctagaaataattcctgccagcaccagccctattctaagtcctactctaggtactagaggttcttcaatgcatgaaatatagttcctgtcctcaggaagcctgcattctagaggggagccgggtagtgaacaaatgtggaatagggcaagggccttgagtatgaaataaagcatccatgacaggtagggaagtgtggggagtggcctctctgtttaggtgatgtgagccgcgaacatgaggcagggggtcaggaagccacgtggagcctggggaagggctctctctgcaggtggaacagcgggtgcagagcccctgaggacaagagttgggaagtcagagacagctgcggctgtgaaggtcaagggatgggtttagccgcctgctggagcgactgccctgactctgtacgcagaggatggccggtagggggcgcggctggaggcagtgatgcaggctgagcacgtgttggactggggggggcggagggaggtgaagaaacgtgctgttaggttttgctgacacatcagggcgggggcaggtggagggtgaacgcatgagaataaaagatccaaggatggtttccgaggtttatggcctaggaaactggaaggatggagttgccatttcccgtgatgatgaagattcagggaggagcttgtctgttagacgcgaagtggttgggaggtggccaggccggcgccgcagccccgcccctgagggtgaggaggttgagcaccagcgccaccgtgtggccagacctccccagcgccccggcgcgcttcgttccacccgtcccttggctccagagaggcgggactttgtggagattgacagtgaggggtattaggaattattgatcggcaggggcctcccgtagagctctgcaagagcccagatgtggggggcctggcgaaccttgtgctgggcacgggaatcttggattccgtcactcctgagttgggtgcctagggcagggcaccagccctctgtccctcagcgtcttcatctgttacagactttaggatctttcctgccgaatatcaggagccgctgatcctgactccctgactggtagcactacccctctgaccttcaactgcagcatgagatgctggccgtgctgcctgtgtgttgaggttgtggggtacttggggtgagaagagctgaggtttattgggtacttactaggtgtcagaccctcacaatcctctcagcagcttcatgaggtggcttttattattcttacccccacccccaccattttacagacaaggaaactgaacccagagagaaaaagtaaattattcgacattgcacagtaaggaaggggtgggactgagattcaaacccagaccatttcctgcttctcagtgcataaaaacatttttaaactggcagtgtaatgatgtaggggttataaaccttagtcctgactcagccattactttctgggtgaccttggggaaacatttgcctgctctgggcatgggtttccccacaggttgatgagaggtgaggctaggtgaactcctggagctaaagtcttagggcaaagctttagggtatgttttgcctccccctcacgacccctgctctgtggtccccagccccttccgcctctctggtcattctgctcccagctgccaggaggtcatgcccttggcctcccttcacctgacagctccaccccgcagttttttatctacatcctcttgcatgcccgactgtcatccatttgctgagtgctgagctgtttgaaagcacaaatgctgggctttctggtcccggtgcagcttggcatagtggggtccagagaagcatggttgtaccagtgacctgagtcagctcatgtgtccagctctcttagttagtagttgagtggatgctgacatgagcgtagtgttgggccagcaggacccaaaccctcaggatcctgccaggtgggcgagatgttagcggagctctccccagagtcctgattgctgccaacttcagagatgcccaaactaggtctgtgtcctgttagagctgaccccgctggtggggctgccccagcagaagtcagaccaggaggctggtatttcagagctctactctcctccccagctgggagcaccaggggttctacaagcaccttctctggacatgagtggctgggaagaggccctctccgcaggctgaggtcagcttagccaaaccttccaagggaacagggcctgccacctgccagatgctattgtgccaggcatcagcagcgtggccacagtggcaggtgtgtatgtgaactgaccgtgcccagtgctgctggccccgccagcatggctgctgtattccagaataatagatgtctccatgaatgcgctgagtggctacagttattaatatttgagcccttgatatgtgccaggcttgtgtttcctcctcctagcaaaccttatgagatgagactgtcatattcatttgacaaagatggagacagaggcccagcagagtgacttaacttgctcttggtgaagccaggactgaatactaaccaaaaagaaaaagaaagggaaggcctgtcttgtttgctgtggtttgatgccagccttactacttactttgcctgggcaaggtaaggtgaactgtctcatcttagttccctgtctgtaacatgaagataggaatagtgcctaccgggcaggattatttgtggattaggtgaattaacgcacatgcaggccctagagctgaaccttaacatggtagatacgaagtcatttttgctgtttacaaagtgctcccataccctcaacgatcttggccgtcaggcggggtttgtggcacagagcagcgtggggtgcggctgtaacctcgggcctcctgtgtctgtccctcaggaaccagtgatgacccattccaggactcggaagggcgagagggcgcagaggccgtggcagagcaccagttttcagacctggacgactcggactcggactcggacctggacgaagacgaggatgaggacgaggaggagagccaggacgagccatcaggcccgtcctcggaggcgcccccacctggcccgccagccacgctgcccgcagactcctcacccgttcagggccctcagcccacagaggccacccggggcagctcggtctcagaagccgagcgctcggcacccagcagctgctccacatccagccaaagcatcctgtgcctcccccggctggcaccggccccccggggcccagtggagaaggacacaggctcggccctgagctcccaggccctgtccccaaggaggccgtggtccccaagcaaagaagcaggcagccacctaccactcaccccaaaacactcactaaccaaaagctactcgtctccccagcgacattcaccggcccgagagccactggcctcagccccgagtccgcctggctcccagacgggccctctcccctgcgggtccccgagactcgagctgtcgcctcttgccctccaccccctgggaagggaactgccacttcgagcgcgcctgccccccgaacgcaagggcgctgcagacccaggcccccccagacactcgcccaccaggagatggtctccaggccaggccgagtcaccaccacggtcagcgctgccagggaagtgggccttggcagggccgggcagccccttggcggccgagcgtggcccaggctcagggctggccccccgggctctctacccgcccgcgcctctacctcacaagcttctcggcagaagcccagcggagacctgcacctccacatgggtgagttcctgtcccccaagtggctgatgggtggggggccgcgagctcacacctccctgagcgtcacacccagagctggacccctgccagttcagcggttaccaataaggcgtgcattgggcaccacttacacaggcactgtgctgggtgcctgaaaccagtcagctgtgtgtcagaagcagcggagcatggactgtggagctggactaaaagaaagtgaaagtggaagtgttagttgcacagtcatgtccaactctatggactgtagccggccagactcctctgtccatggaattcttcaggcaaaaatactgaaatgggttgccatgcccttctccagaggatcttcccatccctgggatcgaatccaggtcttcagcatcacaggcagattctttaccatctgagccaccagggactacctgatagtttttaaattctggactacccagaattaaatccgggttctgtcacttacgagccgtgtggctttagatgtggtataaacactcatgccatctcctcccaccccatttccacgtattctttgagcagatggcagagcccaacccaaatctccacatctccaacatgactgccaccagcaccctccgagtcacttgagccagctccttcccatcttcccatcagcaccgtcactgtcacatcatcagtgccatctgccatcagtacactccagccaccccataggcttgatcaccgtggtcacaacatcactgccaccaccacggtcacgatccccagcactgacacgttatcatcatcggcttacttttcctctcccaacaccttttctgtcactggagtgtcacgacccaacatctctgctcaccgccagcagtgtcagcaccatcactcaagcgattcaagctccaggagtagtaccatccaggaatcttaacttggtttttaatttggggctcaagttaaaattcctggtggtgaaaaagtgaaagtcgctcagttgtatccgactctttgtgactccatggactgtgtagaattctccaggccagaatactggagtgggtagcctttcccttcaggggatcttcccgacccagggatcgaacccaggtctcccgcattgcaggcggattcttggtggtgggaggaggttaagagcctggggtgggaactcatgttcaagggtaaagttgggtcagtattgtctgaggaacaagagaggcagcagaagcaagagagagggccagcgcacagaagccaacagaaggggcagctccattctctgaaaacgaacgcgctggccagaagcgtggggaccttggttcctgagtgtgcctatggccactatagggctggagatggcccattccagagagggcacccacccagggtgccaccgttggcaagggttgggactcaatggtggcccagctcagctaggacctgctctgtgatctcgccaagccccctcctcactctagtcctcagggtctccaggtgcccagcaggtaaccctcgccttcctctgtcttcttttctgaccctagcagaaggccgagtcgccaagtccgtcctgttcacctgctcccgctcatcctctcttctcccgacccttctcggccccccatgacttccacggccacagcccggcccggacggagaacatcttcagccacctgcctctgcactcccagcgcttgacccgcgccccgtgccccctgattcccatcggcggaatccagatggtgcaggcccggccgggggcccaccctatcctgctccccgggcccagcgcggcctgggtcagcggtttctcggggggcggaagcgacctgacagggtcccgggaggcccaggagcgaggccgctggagccccaccgagagctcgtcagcctccgtgtcccccgtggccaaggtctccaaattcacactctcctcggagctggaggccagggactaccccacggagagggggaggacgagagggggcctgggcagacctcccgactgggagccccgtgcggcccaagtgcccacagagcccacgccgacgcacagcccccgcacccccccagagacctcaccccgggcacccccaggccaccgggcagagtcccggagcccccacctggagtcaccgcgggtgccggccaaccctgcggcctccgccaccccgccgctggaccgcagcagttccgtgggctgcctggccgagaccgctgctcgcttcccagcccggaggaggaacctctctggggaacccaggaccagtcagggctccccccagccctcgggaagtggggggtccgggacacctccacaccagcccgaggagcgggggccccggagcacttagcctctccctgaccacttcagcatctggtttctggtgtttggcaacagacgtttccagccgacttcctcgagtcatcttgctgtcacgggctccctgtcccatctgttgatctttccaagcagcttctgctcagcccccatctgtcttatcttcccacctcgtatgcagttacctgtgcctttttctatgaccttttgttgcttgaaaagaaacaacacacacacagacataaaaaaaaaaaatcccacgaggagactgaggctgtgaatatttagatgggacctcaccctgggccactgcgatcagcagccccccacaaagctggcaagaggcagtcagttgctgaaagaaaggggatgcactgagggagagacagagaaaaaaaaagaaacttttaaaaatatataagtaaatgtaaaagcaagcactcctatgtacagagtttatggttcctatttattgctgcttcatcccaccccagctagtggcctcccctggctgctagcagaagggtcagcggcccaaggcagagggacaggctgggagactccatgggcaggcccagaaaactccaactttccttttccaaagataaggtaaattttcctaggatttcaacacaaactgtttggagcaggtagaaggtagttgctggttgggtccccagggctcgcagacaccctggtggtctgactcgtgaccccattctggcatttgactcatagacaaatccccccaccccggcacctctactctgcactctgccctcaacctttggactggggaaggagccctgaccacccatctcccggttcctgagcacctgacctcggccttgctctcagggccccagccattgctgcgcctttgttctagtaactacccacaaggctgaagggacaaggcctaacccctgggggtcaagatccaaggtgcattgccttgccattcccaaggccaggcttgggcttcatttcacatttggtccctggggtacaaagggctctatttcctccatgactgggcttttccggtacttagcactggaagtttccaaggactcatttctggacctctttgcagcaggaccagtcctcctattggcgtgtcacacactgtcaggcctctactatccccaggaagtacccagaaccatgactggtgggaactgcccaggcctcctattggttggcttaaatctcttttaaaaaataaaattatatatgtgtatatatacatatatatacatacatatatatatatatatatatatatatatatatatatatatatatatatatagaaagagaatggtgtttgatatttcccctagcctcctattgtccgaggtcatttcaattcttctccaaagcaatcaagaataactagtgcctcatttctcatccccatctcctcctttaagaagctgccctgtgttttctggggcaaaagcctgctttgtaaaaaataataataaatagtaataacatgactagaaattaaaatcccaagttgaaatatagaacttgaactctagcatgtttacccagccctgggatatgtggggttttccccaacctccagaaattcttttcttttgtctctaccagggggagaaagcacaaggaccgtggtcacagcccagccaggctaggtgctaatgccgcagagcagggacctccttggccggtcctcattcctcagccaggctgtatgaatcctgtggccagagggggctcctgggctgttgaagttgcttagacaggacaccataaggtgcagagggctacaccatgcagaggcacctctgtgggctcctacccttgggcgtaattccctcttccaccagttcaggacttttccttccttggactctgctgccaggacaaactagccaggccacctggttcatttccctctggctaagacaaaaaggggacaatagggatgggcttccctgggagggggtggctgggccccagggtgctgaggctagggttaaccagcacttcctggctgcctgacccagggtctgaagctcttggtccccctggaagaaggctaacaagcccagccttggctatgctggcacttgtgggtcctggcagaaagctggaaggagccccggaccccagtcacagccttggccagaggctgggtttttcctcacccttgctttccaaccttaccccagggcaaaggtgagggacatgggaaggtggctgcctaaggactggagacttcaagggccgaggcctgggagctgaataaagggcattgcttcagcccaggcttgaaatcttcctgggcaagatcttccagctcccaacctacagagcagcaaacagggggctctgctagagtagcccctgaccttgggggtagccaggcccctcctccaagccctgccccacagctctccccggggcatcattcctctggtactcagacagcccaactactaaggtttccttcctggagccctagtcatggctggtggtggtcagcaggggagagtcaggcacaggcagaggggatgggggccaggagtcaccagagacccatttctcaatgacagacacaatgtgcaagcaatctggccaaaaggttgttgccctgcacaggcatccagagaaatggacttgatgccacccgcctgggctgtatgtcactgggcatggctctcaccctctctgcctcactcaactcctgctcccccaaacacagagctcccagcccgcacgcacacctgcatgataagggaaagactctcacatcacaccctcctcctgccctgctcccagccactttcacatttccagcctgcctgtgacactgttgtccctgttaagggacacagtggagaaagcagtgcccattgttggcacagacacctgtgcctgttctgctgaaatgtgcaggacagtcattcctgggtacaggctggctctggtcctcgggtgttggcagccttgcgggctggagaccaacttgctggggtttcagagccagctcttgtcatggggattccaagccagccggcccccagttctaccctccaggatgcccttcaccctcaggacaagctcagggtcattctgggcactaacctgttcctctccaaggcaccttttacaagcctacttcccctgccccaccacccaccaaggccccgactactaagaccctccaggaagtcaacagcagcgaactgcccactctcccacctccatcacctccaacttccagacccagcagtcccttcacctctctctgtgttaacaagtctgaaagatttaatttctgggtccaggtagcccctgctccatcctcacccaacccttttgaataagaataatcaagataactaagctgaattgctttctagtcctttctccagacaaaacctcttcaaaataaaagtcctgcctggacagtcgtccttggagacagatctgcagcactgaccaaggggagaaagttcccaaagacctgttccaccaattctgctcctgagtcgtgaatcctgtctgctttccatcagaaaactgcttcggcacttatgatcactttactaagcctagtgttaaaaaaggaagagaaaagaaacagaaaaaagaaatgtataggcaaatgtaagataacacgctctctgtaagatagaaatttgccttttttttttttttccctaaaaggtgtatgtattctgtatgtgaaattgtctgtagagagtttctatgttcttaaatggcaatacattccaaaaatcgtactgtagatatgtacagcaaccacactgggatggggtagttttgcctgtaactttatttaaactccagtttctctacttgcatcttgcaatgtcggtatggtatatatatcagtgcaaaaggaaaaaacaaaaactcccacaggtctaaagcacagagtctgatgtacaaaaagaaaatactgctcagtattgatgtgtgacctttgttgtaaattacatctgtactgtgaatgagaagtttttacaagtataataattgcctttattatagctctggctgagtgttcagcctgaggatattttttaaaaaaaaaacagcacgttggaataaatttgaaaatcccaacagaggcctgcttgcccggctcatgatttttcttagggctgtagaatgtcagagctggaaggacactccgagtcccaagtgctttttctgctacagagaaatcagggccagggaaggcgagtggccaggccatagtcacatagcctgggattccaagggcccggcccttccaggcttggcaggaggcacgggtacatggccatgtggtttggggtctgtattcatttcctagggctgctggatcaaatgaacaaactaaatggcttaaaacagcagaaatgtgttctctcacatttctggaggccagaggtctgaaaccaaggttcctggggaggctctgagggaggatctgggccagacctctgtcctcacttctgggggctgcaggccatccttggcctttggtttgtcatcacagcactctcgtctctgcctctgccttcgttctcgctgccttctctgtgtgctgtctaagggtcctcatcactggacttggggaacacgctcattcaatatgatctcatctctagatctttaactgaagtatatctgcgaacactccttttctgaaggaggtcacacttacatgttccagggtttaggacatggacttacctttgaggggccaccactgagcccctcaaggtaagacctggaatctgatcgtgacagttattcactgcctgtgtgacactgcgcaagttacacaacctctctgggcttctgtttcctgttctgtgaagtggagggtttcctgtgaggattaaatgagagagtatatgtgctaagtgctaaatcacttcagtcgtttccgacttggcgacactgtggactgtatagctcaccaggctccaccatccatggggatcccccaggcaagaatactggagtgggttgctatgccgtcctccaggggatctttctgacccagggatcaaacctgcggctcttatgtctctggcattggcaggcaggttctttaccactagcaccacctgggaagcatgcatacagcatggttaacagaaccttgaatatggtacggcgtcaacaagtgtcctctgagcagacctcacacagggtgctgtggttacaaggatgaaaaagtcaggtataggtccccaccttttgtatgcaacaatgacttgctctgcaccaggcagggactaatcatcagatacaacagtgagcaaatcagacagccctgccttcagagaactttcattctaatgggagaggccgtccttaagcaaataacgacatcatcaattcctcagtcccagtggccgtagttgttgctacaggagagaacaaagctctcacacagagtaagtcctaaaactcctgtgggctctggagcctgggtgggttgtggggagggctgcaggtggaggtggagtggaggggaagccatgataggagcagacagaagaagaggtacgtggacaaatcaagagaggccttcggggtaaaatgctggacacaagtttagcactaagaacctaagagggcctgcttgtttcagcggcaggaggatcattgctgacttggggaaaagccggcctgttccagcgcccagtctgcaggcccttcgtaaacactgccagtgctgaatggattgtggaggcagggggtggaggctggagagtgaggagaagagggaagtggggacggcagacccagacatcctccccaggacctgaggggagggcaggggagagctgggcagcagctggagggcagcaaggcgtccagggaagaacggagatgggaatgaggtggtgagaccccagcctgcttcattaggaggagatgtaagtaccagatgcagaaatttcccccagtgtgacccaagggaagaggtgcaagtgataacagtgaccggaagttgagaacatttccgccacggaattttctctgtcacctgctgagaagggaagaggaagctccagtatggggtagggggtgcggagcgggggtggtgtggactaaagacttgagaaagaaaaggttggaaattgtctttgttcattattccagaggcaggacagttgtggatgaaggcagtgtggaccacacaggcgtgggtgctgggcacaagagatgaaaaggctgggaagcgagtatccatggtgccagtgacctgaatgttcatctctgctgaccacagggctggactggaaacccaggctgtgagctaggcttcataatccaggatatgggctgtcacgctgcagaaacaagcaagccagaaactccagaactgaaaacaatgaaagttgaactttcccctctgccatctgtcccatgtgggtcagcagctgaagtgtactcatcctcatcatttggagacctaggctgctggacgctttatcccgtgttcctgtgacctcagaggcagaagaaaggagagagctgtgaaatgttgcattgacagctaaatgctctacatgggaaaagacatctctcctttcaaatttcacctgccaaagcagatcatattgctgtgcctagtgacagagatgaggaatatgtgtgacagtcacacaaggatacgacttcccagtgtcagaaacacccaagggctgagcagatgtcaatgatgggatgggggcagggacagggcctcatggcatcggcctcaaaggtgctgggtttttacagggagtgaaaaaaataatggtgtgcaaggaggcctggaagaaaatggcccctggcattttgatcatggggtgtggaaggcaaggagcagctgtctgggagcgagtccttggggagatcctgaatttcagtcgagaccagtgggaaagtggaatcccaaaaaggcccaggagaagaagagcacagaatggagccaagtccggcctccagcattttacaagccctatttatagtccttgggcttccttggtggctcagtgaaggaagccacctgccaaggcaggagagataggttcaattcctgggtcgggaagaacacttggaataggaaatggcaacccactccagtattcttgcctaggaaatcccatggccagaggagcctggagggctacagtccatggggtctcgaaagagtcagacatgactgactaaaaacaacaatgtatagttcccaacgacaacccagggagatgagacttacggtccccatttttagagaagaaagtggaagttccaaagagcccccaccaaggacttcctgctaagactctgtgctcccaatgcaaggggtttcagatttgacccctgttcagggaactagatctcacacgccccagctgagagtctccacgccacaacgaaagattccacatgtcataactaaagatccgacaagctgcaaagaagatccaggatcctgagcagatcctggaaagatccactttccaagttacaacaaagactcggtgcagccaaatgaatacaaataaagaaagaaagaaatattaaaaacaaaaggacccccaccagccaaagatgcagggctggttagaggctgtgtgagactgactctagcctgactctggtgcagcgcctctgggagccccaagttcctccctctcatctcctccctgtgctctggccccaggggagccctggatctcagactcttcacctccttctccccaggaacccaggggaagaggcaggcccaggccaaggcttcttcccagcagctgcctggcttctcgcagccatccaggatagccccgtgtgtccccgtgtctgaggctgaaggcgcagggatggaccatcagactcaggggctgggattccagtgctcgagagcatgccaagtgcatgcaaactctctgaagaacctgactccccagcctgctgctggcacccaggcccacctgtcactcacaccaagcctcccatggcctctcgtattcacgaggcaatttcccttttggagtgagggagatagggcacctacttccacttcacagaagaatagatcccaagattgcaccctggcaagtggcagggccaccgacccgggtcacacctgacccagaacctcaggaaggcttgggctgagccttgccactgcccatcagggctgggccttctccctaggcctagaccctctctgggcttaagacctagagaccatgcttactcctagagattcccagggacaaaccacggctggcaggatggcctcagaaggcaggccagcctgagatgggcatgagcagggagaaacaggaagcaaaaagagtcaaataaggatgggggcgactgaggagggagcagcccagggctgccctgcgtgggactcatcactgccatctggcccggggagagacttatcacctcgtcactttgtagaggaggaaggctggggcttggacaggtgatgctgctcataaggccacagtggtcaggggcagagcagagacttaaaaccaggcccacacattcagggagtggttgggactatggaaagggaatctgggcctcttggctacctcttagtcctgaaatctgggttgggggaccccagcagacatatcctttaattccatccagcctcagccactttacagagacccagctaccaacctcccccttttataaatgagaaagttgatgtccagagccgggaagagcttggcccaaggccagagctaggattcccgaaccctcagcagagccacctggaccactccgcccacccctccttaccccaggcccaggttcacctgcccagatctgcctttttaggaaaggaaaggagcagccctggtgggggcaggcgggtgggcaggcagccacgctaatccactagctcccggaggctctggttaccgtggtttggggcccgggcaaccctggctgggagtgccagcccagccaatcggtgctgccgctgagctactctgccagagccatacaaggctttgctgcagccctatcttgagccaccacaggacagccccagcgtcggcagccgccccgcccgggagcctgccagcccggcacgtcctcggactctgcctaatccaacctggaagcaggcagggctgcagcgcacgtgcaccgggcccagggttccccaaggccaggaaggtggcactgccagggcagaggccagaatcggggcaaagacctagccgggcatcggagatcctggctggggtcagggatgagctcaggtctggtccaggctgagctgtatctctctgtaagatgctcttctgttcccatcacccctttggcctgactgactgcttatccttccccattcaccgtggagacggggctcagcacagtgagtatctggtcccttctgaggtcttctcagggtccaagtcccaactactctaacccatccagggtctgaggctgcatgcacctctcagaattggggcgtccatttctaagtgcacgttgtgagcatcaggcacatacagccccccctgtggtctttgggggtccactgtcactgccatggatctgggccttggctgtggaagcaggtggggaccggtgacccctgcccagtggagcccatcccatctgtcagtgcataacacctgagtgttatgaattcacaggacccccgaggagtggaaactattggccctgtttggcaagcaaggaaatcaagtcacagagaagttatttgtctgaaactggagtgtcaggattcagccccagagtggtctgactctagatctctagaaatttccgatcctggagggaccaggggctgccatttacactgaagtgtgaatggaggcgagaaagtcattgtctgagataagaggaccctttctttaaaatatgtatctttttattctttcgttgtttttggctgtgttgggtctccgttgctgtgcacaggattcctctggttgtgacgactggggctactcttggttgtggtgcatgggcttctaacagcggcggcttctcttgcggagcacaggctctagagcgcacgagtctcagtagctgtggtgcacgggcccagttgccctgcagcatatagaatcttcctggaccagggattgaacccgtgccccctgcactggcaggcagattgccaaccgctggactatcagggaagtccaagggtgccctttgttcctgaattgggtagggccaggcccccagtgcacggccattgcccaggccctggtcaggttgcccacgcatgcagcggcccctgcagagcgtcccaggccaccactgtcaattagatttgtcacggaagttcactgggttccaacatccttgtgtgtcctacgtgggccaagttgagctcaaagccaagactgcggtactccccagggccacccggcaggtgagagaaacgtgccgacctggggggtggcaggccaggctggcattaggctctgtttgctcacccaagaaaggaagagataaatatagacacaggattactcagacacagcctgggaaaaccggctccgaacctcgacttcagccctggcccggtctcaccttcacccgcctgccccctcggtgtctgctgccaggcctgccccacctgttcccaggacgccccacctgcaaacttcaggacagccgttcctgcctgccttctgggggcaggacagaaactgaggcccagagagagcagggcacccgcctcacatcccacagcaggttaggagctggtgacgcgagggctgcactgcgggagtcagtttatcaggtccaggcaatgcaccagcccagattcggtttccatatttgtgagatggggacctggtacccccggccctcaacgccctggagcctgcgtgtagggtagagttggagaccacgcagcagaaaggggatgaagctggaggctcaagcacaggaaatgctggcccaagccgcatgtgtagggcttcagcactgggactctggagccaaatggcctgggcttaatatccccctccaccattttcagccaagagatttggggcaagtttcttaacatggtgccacaatttcctcatctctaatataagaataataagaattgttattctatacaataaataatatgtacagtattatttgggcttccctgggcggctcaatggtaaagaatccacctgccaatacaggagacatgggttcgattcccgagtcaggaagattacctggagaaggaaatggcaacccacgccagtattcatgtgcttagtcactcagttgtgtctgactctttgcaacccttttgactgtagtccaccaggctcctctgtccatggaaatcgggggcaagcatactggagtgggttgccatttcctcctccaggggatcttcctgacccagggattgtatcacatctcttgtgtttcctgcattggcaggtgggttctttagcactactgagcaaccagggaagcccaaataatactgtctataatactaaaatcccatggacagaggagcctagtggactatagtcgatggagtcgcaaagaattgaacacaagtatgatgttatatatatgtacatgtatatgtgtacgtatatacacgtacatatatgcacatacacataggtattgatacatatatacatgtagacatgtgtgtctacccacatttgggtctcgcaggaggtgctagtggtaaagaatcctcctgtcaatgcaggagacataagagatgcgggttcaggtccctgggtggggaagatcctctggaggaggggatgccaacccactccagtattcttgctggagaatcccatggacaaaggagcctggtgggctatagtccatagggtcataaggagtcaggcatgactgaagtgacttaccatgcatataggcaccggtattcttgggtgggaaatcccatggacagtggagcctggcgagctacagtctatagggtcacaaagagttggaaatgacttagtgactgagcacgcaggcacatatatgtagatgtattatttacatatcattacaataataatagcctaataacaataccaacctctcagagtgttggggtggattaggtgagattagtacaaagcacttacccagggcctgacacagagcaatgactccacatgcatgtttatgatgatgcagccactggggcaggtgggggcctgggcgcaagaggcgtgggtgggcgtctccaagtctcctgccctccaagggaagagctcagccctgagctctatggtgcgttggtctctcctgcactgtgacccttgcagcagctccctgctctgcctgaaagcttcaagagtcaggcagacatggatttgaaggttggctcccacttacgggcttcccttgtggctcagctagtaaagaatttgcctgcaacgtgggagacatgggttcgatccctgggttgggaagaccccctggagaaggaaaaggctacccactccaggattctggcctggggaatttcatagactgtaagagtcggacaaaactgagtgactttcactttgccaccacttacagactgtgtgaccttgggcaagtaactggccctctccaagcctcaaaatccacttttatccctcttgggattggtgtgagggttaaatgggggaacaagtgcgaaactctcagttcagccaggcaagtggactctctatgcttgagctcatcctgagccccatctcttgtttcctccagtttctctcagtggctatgagctgagcccaggacaggtgcatgaccctctgggtgcatgaccctcacacatgcaagggttctcagttatgggaaacactcaccagcccctacatcatgcatgagctcatgttcctgcccttgggtccctggagccatcagagatccgcaagttccccctgtactcttcatgcactcgtgcatatccacacaggctccctctccacattcctgcacacgcacatgcgtgcatctatggacacacagggcacagctgtgtgcgagctcggagaggctggtgcccacaggtgtgtccctgcacacctcaccagcacgcacgctgccacagtcaggggtgttctagccaggcctgccctagccaggcctgcccctgaggtggccgtcttcacagcagaggaatgcagacagctggggatgctctgccagcggacgtgagggagaggcccaggggaaaccacacgggcaggaatccaggcaggcgttccaggccaaggtggagtcctaaggtgtcaggaagtgcggggggggggggcatgtgcagactctaacttgctccagtctcctctctcatcaccctgtgtcctcagcctctaggacttggaggccaaagggttgcacagaccaccgttctccatccaagacagccagccagctctacctgcacagccttgctgcctagcagagcactgggtctctgggctgcagtggcctggtctcagctagaagggatcattcttggcatagggtctttcttcctcactggggaagaatctatgatcacagaagaatctatggggagaatctatggggagaatctatgacccagaagaatctatgactgcagagatcagcagaagaggagtgggttttttttttcctcatttttattaacatatagttggtttacaatgttgtattagttttcctgtatagcaaagtgaatcagcaatatgtatacatatatcccccctttttcggatttccttcccatttaggtcaccacagcacactgagtagagctccctactccctactactaataagtagattctcattcagttcagttcagttcagtcactcagtcatgtctgactctttgcgaccccatggactgcagcatgctaggcctccctgtccatcaccaactcctggagttcactcaaactcatgttcattgagtcagtgataccatccaaccatctaatcctctgtcatccccttctcctcctgccttcaatctttcccaacatcagggtcttttccaacgagtcatttcttcgcatcaggtggccaaagtattggagtctcagcttcaacatcagtccctccaatgaacactcaggactgatctcctttaggatggactggattggatctccttgtagtccaagggactctcaagagtcttctccaacaccacagttcaaaagcatcaattctttggcgctcagccttcttcacagtccaactctcacatccatacctgactactggaaaaaccatagcgttgactagacagacctttgttagcaaagcaatggctctgcttttcaatatgctatctaggttggtcataactttccttccaagaagtaagcatcttttaatttcatggctgccagtcaccatctgcagtgattttggagcccagaagaataaagtctgacagtgtttccactgtttccccatctatttgccatgaactgatgggactggatgccatgatcttagttttctgaatgttgagctttaagccaactttttccactttcctctttcactttcatcgagaggctctttagttcttcttcactttctgccataagggtggcgtcatctgcatatctgatttctcccagcaatcttgattccagcttgtgcttcttccagcccagtgtttctcatgatgtactctgcattagttatctattttatacatagtatcaatagtgtatatacatcaatcccaatctcccaattcatcccccactctttccccttttggtgtccatacatttgttctctacatctgtgtctctatttccgttttatagatgagatcacctacaccattattttcagattccacacatatatgttaatatgcaatatttgtttttctgacttcactctgtatgacagcctctaggcccatactgtcatcattggctcaagtcagagatgacggagacaatgtggaagtcactagaactcttcaggcaggactcatactgactcagcagccagtgtatgttaggtaaggcacttgcatctagcaactccctgagtgcttacaaaagggcctctgctcccatgtacagatggggaatctgaggggcagaggcggcgtcacctacccagatcccctagctggctgactccagacaccagtacgtaaccactgggccatgcggcctctgtcaaagggcacatctcacaccctggaggagaggtttgcaaatgaggctgaaacactgctggcacatgaaagccactgtcccacatgcaggggcagcccagcccaggtggcagagagggctctcccaggtcacagctacatagagatggcagggggaggctgagagccatccaggcttttggcgtcttctggcagcacacatccctggggaccagctgaagctggggaacatgtcagtgttccaagaaatggcaggcacgaaggtgggacatggcctctgcaagttcagccctggggtggagagaggtcattctccatcttcatacagaaaacatggcctaagagggacagagaccaaaaagttccagaagagactgagcagggagaggggctgccagcggagacctgcctccacttcctgaatctctgaggccagggtgacaagtggtggcctcctgtgaaaggcccccgagccaactaggtccctcaccctccagctctagctatttgctgggtggaactgctggggaggagcatgctaggccctggtgctcaggacctcatggatgagggaaggaagaagggagtcagtgcttgaaaaaagtccatctggggaccttccctatactccactggccacactgcctgccccctgcaggttctgtttacagacctggccatttatttacttgctggggagcaaaaatgggaaaatgacagtgctgtcatgggaggacccggaggcaaatgacatgcccaaggccacacagggcagaggattctgacttgtcacaactgctgcttccaggaacacccagatgcgtagccccaaggcgtcacgctacactcaccggggctgccctggggagccgagcctgccctccaactctctggaagaacagggacccaggcacactgcccccggggcagatgactgcacttctctgcgcctctggttcttcaaacagcaatgccttccactcaaggctgttctcatcatccgacggcatcgaacttagatcaaagcatgacctggcacaaaaagcctctcaggcgcctcccctccgcccgaagtttccaaagacttctctaggcctctgcactccttcccaaggcacagctggacttgagacctcgttgtccagcacgagactcaggggaggaaaacaaaccaagaagccagcgtcaccccacttgtcagctggacagacccgcggtccagagaggggcagtgacttgggggaggcacacaagcaggcaggacttctcccataccagcttcatggagagaacaggccttggaccccacgtagtgtccccaggggaccctgggggtctcgctgtggctaagcggcctctcatcccacccaccggccctgcccccaggggttgccgtcctgtgacccacacagggcgctcgggctgccagggccttttagagtcagagccgctgagacttgggaagggggctggcctccctgaggtctcctggggtccccagcagggcagctaagacctgagtccccagcggcacgtggcggcgctgcccgatcggtgatgtcaggcccaccacacccgggccccagcacgttccttctcagagtcggcagagcagagaacaaagcgtcctgcgcattcttgcacgctgactcatcgcctgcacgtagagccacagcagctgctttgcccaaaattggtcgggaggcgggggcgcgccagacatggcagcctggggtcctctgctcactcacctgctccacactctccaggagcccccagtcccaggatttcccaaaacaggcaggaaagcaagaggcactggggggcatgctgttccccaggatagccagggctaccccctgggggagggctcgtgatcaggcacaggtggcaggctggggataaggcgtagatgcaggcactgcttgtctttgagcctcagtttcctcatctgcaaaatggggatgtgccagttaccattttaagcgtttgatatgagttcttttcccatattcttacaccaaccccaaatggaaatactgttatcatcatcatctcacaggtagggaaactaaggcacagacactgatttgcttgaggtcaggtgctagtgggcttccctggtggctcagtggtaaagaatctgcccacagtgtaggagaggcaggagacatgagttcagtttctgagtggggaggatcctctggaggagagcatggcaacccactccagtattcttgcctggagaatccatggacagagcgtctggtgggctacagtccatgggattgcaaagaattggacacgactgagcactcacccaggcacaagtgctagctagctgcagaggtaggatttaaatatgaattgtaaggttccagaatctgcatgtatcccctatatgctaaaatgcggattgaaatatctggtgcccagcaggtgttctcactgtgccctgacccttggtggttgagcctggtccctcacttcacctcactaaacctctaatccctcacctgtaaggtggggtaactgtgaaggatgccctcaagggattgtcagggaaattacactgaaggttcaagtgtgatctgtggaagaaaaggtagatttggttcaacaagccttcaaaccacctttggtcatctaggccaataccaaagtacagagaggagacgagctatgcctggggtcaccagccaggccaagccatactcgtctgggcctccccaggagtctggggaacacggagttgcctgtactctttgggaaagtgagggagcaggaggggccctgccatattccctctgccagcctggcctctcgcccccgacagcctgatttcagagaaggtggagttctttggatctgtcctgtgtcggggtcagaggcttgccctgagtttgtaggaatgaggtggccaccaggtggctttgttctcagctcttacccaggttgcggtgtcccccatctgaggcttgtctgatagtccagagaaagccctagaaggaattcagcacccctaccaccaccagcccccgagccaggcctggtctgggtcccagcgggtctgggccaccacggcacagatgcgcaggactccactctgtgcgctcagtcgctcagttgtgtctgactctgcaaccccatagactatacatagccaatcaggctcctctgtccatagaacttcccaggtaagaatactggagtgggatgccatttcctgctccagggtgtcttcccattccagagatcgaacccacggctcctgaatctcctgcatcaacaggaggattctctaccactgcgccacctgggaagactccactttaagctcaggaggaggtcagctcgggctgggtgtgcacggcctgtgcactggcctccaagctcctttcatccctgggtcctgcacactctttgctccagctcctagcacgtgccatgctcttccaggtctcccagcctttccccatcccatacctcttgcctggaatgccttctccaccttcagagcctcttttggatgcctcttctgctggaaagccatcctgacctttcaggaagaggcaggcactcattcctctggggtcctgtagctctttgtcctccctctttggccaacagaaagactgacacagaacacacactggcccttatcccatagacccccccccccgctgggtccatattccaagaaaaggccttcaagggccctccccccaaatcccaactgggacagagacccacagacccagcccaggtcttgcagagcaggctcagcctgtctactgcatgatggcaaaaggcacagcaaaggcgcctgaactcccatctcttctgctcctggctgtgtggccttgggcaacgcctgtagcttctctgaacttcttcattcccaggccttgccttgcccacttcccaggcccgtttggaagatcaaatgaatgaaggcagagagaatgcttggcgcgtgggcacagctccccacacagctgtcattatcaccgagtcattattacggacctgccttgtgcctggggggggcggtgcctccaaggctgggcagcaggcgggcaggcaggcgatgaactcagaagcagccgcagcctgggctgactcaggctgaggcactgggagaagtgggtgctttatggtcagcctgagccagcccagctctggccctctcctcctacccccaggcgtcacccaaatctgaggccacaaggccttccaggccctttcagggcctcttatctgggaagataaaggccccctccccttgaatggtggatctattcaaatggcttctgtgtgaccttggcaacagtcaccctctctggaccaggcttggggagttccggggtggggggcaggcagtgacctcaaaaggctcccagtgtgtcttccaggtgcttagtggggggactctcccactgctttgggccccagagggatggctcctgttctctccctccctgacactgacctgctgctgctgctaagtcgcttcagtcgtgtccgactctgtgcaaccccatagacggcagaccaccagactccgccatccctgggatcctccaggcaagaacactggagtgggttgccatttccttctccaatgcatgaaagtgaaaagtgaaagggaagtcgctcagtcgtatccaactcttcgcgaccccatggactgcagcccaccaggttcctccgtccatgggattttccaggcaagagtagtggagtggggtgccattgccttctccaggtgatggaactcccagtatcctccctagagtctggagttattatttttatctgacacataagaaaaatgaggcccagagatcaaaagaccctcacctaaggcagcacagtcaacagccaggacacaggcatgtgaccctgccagggtcttcagggcccacctactgcaatcctctattctcctgtggcctcctggctggcgacggctgcctctctctttccctccctggtggctcagagggtaaagaatcggcctgcaacacaggagacctgggttcaagatcccctggagaaggaaatggctactcactccagtattcttgcctggaaaattccatggacagaggagcctggtgagctacaatccatggaattgcaagagttggacatgaatgagctactaacactctttccctacaccctaggacaccagctctatgccaaggcttggacaacagtcaccaacttatgagatcttcacatgaatgtaagacagaggaggaagtcaaagctcagagagctggaattgcttggcctggtcacacagcacagtggtggctggaggctcagtctcccatacctctgctctgtgccctagaacagctgctaccccaggatggtaggggtttgaccaggcctcagggagcctgcagggcagccctctggtttcacagacaccccctggctatgggtgggccaaagaggaagggtacccatcctgccaggatggacctaccaggcccacctgggcccgacgctccttgccaggctcagatggaagcatgaggtcattgggccatccctgctccctgttggctctcgctgctgtgactcagccctgtcttccccaaacctccttctccagggaactctagcaatggtctggcctggccaggtctgctcccgctgcctgtccaccctctcagggcctcccagcctgagtcaccgctcacctcaccacctggcacaatgctcaccgcataaacagactattcccctcccccaggctcccagggttcctctccctacagcccaggagccaggctgaggggtgggggcacttttcctgctgtccccagacttcggccctgaggtccatccccagaacctactttcagggactctctggccttgataggaaaatctagaattgagattgaggcctcagcccagggctcagactgacctgggctcaaatcccagctccttccttgttaggtgggtgaccttgtacaagatacctccatttgaaggagggcaacagtaaaaccagctgcagcccatgaagatttcctacagcatcaccgaggccaggatcctgcttaaaaatgcaggtggctctagattcaaatggtggtatggcctcgcgtaagccactttgcctctctcagcctcagggtccttacctgcaaaatgggaacgagaggaagagagccctcctgctgtggtgactaaatgtgataagacatgaaaaaggtcaagccgtgtctggcacccagggaccaaacacgggtaaacgtttatgtggataaacggtagctgtaattaaatcttaaagtgacgtgtgcataacacatagctcgtgggaagctgccacatagcacagggagctcagctcagtgctctgtggtaacctagacagtgggatggagggggcaggcagagggagatccaaggaagaggggatatatgtatacatatagctgattcatttcactgtatagcagaaactagcataacattgtaaagcaattataccccaattaaaaaaaaaaaaagtgccaggcgttaagtgatcccaggatggttttaatgaatgatggggagatggagagcaatggtctggctcttcactggatgatggagtagcatcagggaacggcttcccaggttggaaagctccagcatcccctctgcaggttgaccaccccacttcccttagtgggtccagaaggctctctcaagagtctttctggctggggctggcctcacagttttccagtttccaggccactcaagaagcacttcactttacagaggacaaagctgatgctcagacaagggaaggggcttgtctgcagccacccagctggaagctgagcccaagcctgcacttccgtgttccccttcttcccagcctgggagctgcctccctggactggggataccctcacctcccagtctcagagagcactctgggagagtctcagagcttgtctgcacactggagactctttatctttgtctctatcttcccccgtaatgctcgagaggcagctccttgggccatggggccagtgaaagaggagaggacccaggagaaaacttctgtgacctcctcatttccagttcaacgggtgatgtgttgagcatgtgatctgaatgagggaacagaggctgggggaggtcgcatacgtaaagggtgaggggatagaaataacactgaccctggggtcaaacagacctgaattcaaaccccaaccattacacgtcaagctctctaacttctcagaatctgaagttgcatctgaaagcagatgccttgagatgcctcaaagggttatgctgcaaagatgaagtgagagcaagagtgtgaccaggctccgtaaatagggatgaaagtgaaagtgaagtcgctcagtcgtgtctgactctttgcgaccccatggactgtagcctaccaggcttctccgtccatgggattctccaggcaagaatactggagtgggttaccatttccttctccaggggatcttcccgacccagggatcgaacccaggtctcccgcattccaggcagatgctttaacctctgagccaccagggaagcccgtaaatagttatagtcagtaataatgatggctaccaccgatggagctcttcctcatttaatccttacacagccatgttactgtgattatacccattttacagatgagcaaactggagctcaaaaaaggaagaaagggcatatgtgatggggaagaaggggtctgacaccagaaccagagaccttagctactagccagccctcagagacataaaataaagcctagccagaggtggttatgggcgtgtgtgctaagttgattcagtcgtgtccgattctttgtgataccatgaactgtagcctgccaggctcctctgtccatgggattctccaggcaagaatactagagtgggttaccatgcccccctccaggggatctcctgacccagggaatcaaacctgcatctctatgtcacctgaattggcaggcaaattctttataccactagtgccatctgcaaaggtggctatggatgagaatattgtgggtgttcagaggtgagttagatctcatgtcttggatggagttgggaaggctggtccatggggtcacaaagaatcacacatgactgagcatgcacgcacgcacctgggggaggcaacctttttgatgggccttgagtttgggcaaaataaatcaagtaagaatggaaggaggaggaaaggcccaccttgcacagaagttgggaggcgagaaagtgtgcagtgtgttcaggaagtgacaagcctctgggaaaaggaaggaaagacaggtccaagtcaggtcccaagcaggccttatgccaggtgggcatttggactgaacaagatgcttcacgctgacaccaggccaggtcctggctccagaagcctggttttcataggaaggcaaattgacccaagtctcaatacccctcatgtctgttgtggcatcaggtactgtgccaaggcaaatgtgggtgagtggagcaagccaggctggccttgggcacctggagggactgtgtgacccagggcagtggaagggatgctcgtggtgcagctggcacatggtgtatagattcacacactttctactacatcccccccaacacacacatgcacacatcactcttttgcaggagtgtgtccacaccaagaggcccacacacaccctgcagcctgaggtgagggagggagagatagcagaggcctgctgaaagaaactcctgtgccaggcaatgggccaaagcgtccacgagctctgccacaaagcctccttgcggctatgaggtaggacttttcttcttaggagtctcggatggatgtgacctctgatactcaggaaaattaaacagtgctatacgcttggtcccaaggttggtgagcagcaaaatgaaagcacagactggctgcccctgccctgagctccgtagggcctgacacagtgctgggcactggggataagtggaggattggagtctgagtcacagggctttgaagctggcagccagagcagcggagcctcagagattccaggggtgggctggcccctgactcacccccacaccctgaggctgccccaggcagtggctttagctcctggccgccctcctgcctgccagagcccagcaaggcctcttctgagtctgtcatggctcaggattcccaggagctgggcgggcagggccaaagcctcaaggcaaggaggtatcctgggcacacctctgctcaggtatgtaggcctagagtcacagtgggaaccccggacctcaccagcctgatgtcagaggcaactaggcacttggggatagctgttaaatgaagaatgaaatactgtatttctgcatggcccagactccgggtggctcaccccttcccagagggaagacagccgcctggtgaggtgctgggtgcgccctggaaagtatgggttctaggcaacacggtgggtgtgactctgcaaaaccaccagctgcgtgtcttggctggtggtagtggagggaggagaaagctggggttccagcccctccaagtgcaggggcctcagagatgagaatccaggcattctggatctccaggatctctggtgggctgttccttctccctgtacctcagtttcctcatctaggtgtaggccaagggactttccctctctggctgcctgtcttttgcttttagaaattatgtccaagccttcatcgttagagcattttgaagatgtaatcaggcagaaaaggggacataagtcttcttcatcttaagcggtgtctctgcaagggcagttttgtctgatgagattaagtcatcttgtatattcactccagccttgggcctggaccatgtgcccaggcctgtgtgctaggccctggggttgggattgcaaagaagactgtgtctcagtgagttcataatttggggggagagacacctctcccccagaaataaccagatatttccaggacagtttaacatgcctttcaaagctctttgacctttccaatatctctaaccacatctgtcatgatggagaatagatgggtgagagattggttgtatagatatatggatggaaggatggataaaatgtcagataatggataaatggatggatcaatagaagggtggatggatggctgtggacatgggaggttgaatggatggatggagggagggatgaatgggtgagtaggtgaatagattgtgggggttgggggtgggaatcattgaatgtgtgatttaggttcctggtcccacagcagatgaatataaggggaaagttccagtcctgcctcttgttcattgtgtgaccctgaagaattcacttctttagctgtagagtgagaatctgtctggaaagacctcacctatcaagtgagagtcatgagcccagcctgcatcccaggtctgttgtgggtatccagtgaaagaggtatggactgcccatgcctacataatggctgtgatgagtcctcagtcagtggcctcacaggcaccggcaacgtgaggtgtttttgctgagggagtgacgcccctctgtggttgctggtgtgttcctaggcttcccacttcctccagcctgcacagagttctctgcccagttaggagcaaaggaggtgacctctgcagaagtgttgctgccagaggctccccatacgctgtacttgtcaaggagtaattgaggtgtcctgtttgttattcatctcagggtaagagtaggctcagcaagggggcacccagggcttgggattagggctttggagttacatagatctgccttccagccttggctctgccacttcctagctgcctgacattggacaaggcatgagcctcagtttccccatttataaaatagtaacaaattatagtacctaccccttaggtaggttatgacaattaataagcataacttatgtaaccacctaacatagagctcagaatatattaaatgcatgtgtatccaagtgcagaattgcgcccttagaactttgaagaaaagtccaaaacttcaagtctagagacctccatcttgaatgctcagtccttggattagtttccttatttcaaaatgttcagtgggactgacattcttcttgacaagtgtgccttgactgaacagtgtctggttttggctgcaattccaggagttccatgggcctcgctgaccctgtcctgattacccttaggttaatagcagactgggcacatgaattatccctttaaaagtggtttgtgtgggagctacaaatctttccaatgggctgagctgtagggaggaggagaatttagaagggggtgtcctcccggggaagccgcaaagaccaggagagctggtcccacaggaccgaggctactcttgcagagacccagtgtggggacgatgccgtgggcggtggcaggccctgctggctcagggtgagctgcagccgatggcaaggggcccagaccacccaccagaaagaggccctgagtctgagtggccctaggcttgagtgggggcagtcctgacctgtagccctgaggacataactcgggaacaggtcattatgggaatgtctaagctccctcagtcccgaaatccccaactcaggctggctccggggccataccctccccagacccccattccttgcagggtccagatatcccccttggccagccccatctgcccatctgctcgctctgctatatgcctgcatggtatgtgcctgcgactgagactctgtgtcccttccattgggactgcaatcaagagagcttcctgaaacctggtggggccaggtgacaacagggaagtggctggttttccagaaagtgaaagagcaaagggttccaggctgggagcaggagtgataacaatgaagtcacagagtctgcagagcttgcattttgggagctggaaactcagggcaggttgattctgcctgtcgtaggctatctgagctgagcaggcccctcacagtcgatgggaagagaggaaagctgtccagggaagccaaggaagggacaggacttgcccaaggccacacagcgtgaatagcaaagctggggacaaagctgcccactgctacaacatcgggtagctgctccagccctttcctgccctgttggacatcatcagaaggatgtttaatcctcgctcctgtacatcctccatcccatgccactggacagctattcgatgggaccaaatttatcattagtacaggggcaatcaaaggagctttggggtccccaggaaggtggcctaggcccatcccaatgtccctgccttcctgccagtgggatccttcctgacagcccttctcaaagggacccagtgcggctcagcttggacccctgggaactacactggtgtgcaggaaagggtgagtctggattagtagcccggagagtgtgtccagcccatcactgtcttgggcaagttgctcctcctcttggacctcagttatctcatctgcccaatgggagtgaaaaccagagagaatttctagaaggcagttcctagcatggtatatttcttcacccaaaaatacaccccaactatcctcttctgccagcccgccctccccacaaatctctgcttcttggattaggctggtgccaagtgtaagtgaagcaaattagtttgtgtgcaaatcaattcctccagcttctgacagggtgatctcctgtgaatccctgtgcctcagtctgcagcctttaccaacccaggcagggagcggggccaggtggggctgaggcagtgcagcagagcagctggtgggggcagtcagtaggaaccagagcaaaggagttgagggcccatgcagccaggtcagccaggaggcatagaggtgactgtcggggcccaggcctagagacctagggtggatattcttgttgttcttgttgtttcttagttgctaagtcatgtccaactcttttgtgaccccatggactgaagcccaccaggctcctccgtccatgggattctccaggtaagaatacaggagtgggttgccatttccttcttcaggagatcttcccaaaccagggatcgaacccacatctcctgcattggcaggcaggttctttaccactgagccatctgtgaagcccacgggccaggaactaaaggaaattcatgtgtgtattggaacagttggcttgtgcagacagaccatgatcatgtcaaaggcaagggaagagggaataaagaaaactgctgtttttaactcggcttgattttctctacctggaaaccaatcttgccagtgaggtggtgctgttcccggaacgctttcagccgctaagaccggggttcgctcaggttcccaggtccggcgtctccatttcacaggagccctgctcgcccggctggagcagcgggcagggaaggagggaaactggagttgggcgcagcctcccaagctgaccctgccaggccgggcggtggcccctgtcctgtcgtcatcctcctttcacagcagagagggatcctgtctcctggtctcgttaattcttctatcatgtttcccagactcggagcctctggttgcctattgtcctgagcaggcattttgcatttatgtaaagattagacaggttagaaccttcgctctcactccgatggtcttttttactttctcaaatccaagttctttccttctcactgcgctctgcttccttattctctctctctccctacctgtctttatcagcctccctgtttattttcttcccttccctgaccccctccttctccccactgacctgcttttcctctgtcctctcttcacagttcagtagtttgaatcctctttctcccccctccaccaccgccaccacaaccctaaccttgcttaattccatatttatcttctcccggagcctcatagaaatgactgaaagcattgctcacctcattccagaaataactcttctaaattcttagagaggcaccgcacgggggagggtgtgagcactggacagggagtcactgtggtttactggagagaacaagacccaggttcctctgtgggctcttgggtacaccagctgtgtgaccgtgacaccgctggcctctggccagtctctgtttcctcccaggcagcagtggagctggcacccagatgagaacagctgtgtgtaaggttgtgaaggagagaggacggtggtgccctgcacacacacttgtgctctgaaatgtttttcctgcttccaccgcagcctgagccagtcggagggaaggaaggggatgctaactggtatctccctccttggttctgctctgctctacagggatcacacatgcgcgcacacacgaacatgccctgggaagaaacaaagctgtttcttcaccgtcatctatttctcccttccaaaatgtctaatggtaaaatcccaactgaacacaggagcaaaaacttgggctttagtgggttcctgaatttctccatttcaaatccaggccttcattcattcaccgccccctccctcggacagcactcactcagagtctcctactgtgtgccagacgggctccagggctggccttctctggagctctggacctcgagattgttggggagataagcccaatgtcatgagtcaggcatgagagagagcacgggttctgggagttccaagaaatgagagggcctttcctcttgtgcctggagacagggtccctgagaaggagggactctgagccagccgaggggcaggagcaggatgctggcccccagggagcccctccatcactctgccttttttgcagaaagtcacagaggtgagccaagacatcctgtcctggccaagatgggaggttttcccaggggcttttggtgtacatatccacaagccacctttctggaaagggctctgagggccccttcttagcatcaaggaaatctgtgggtcacataggttaagaagaaggaaagaagggcacttcctgggggaggtggggaggaggcggctccaggctggtcagtggtcaggggtaaactgtgtccttccctaaggaaagcaggcccagagaaggctctgactctcccaagtccacacagccttgtaggtcatttacctcccacgcagcagaagggacaccctccacctggttgacagtaggcagacaggaaagcagggtctcctccaaggaaagggagggttttgcccatgggacctctccctcccaactctgagctctgggcaagacccatggagagtggggaggggctcacggcatttggaggatgacttgagggggtccagtgggactgaaaggggtccctggggacagcacgggagcctcaggactccaggaggtgctccaggctcagagggagcatcctcccccctttttcctccctcatcctgccctcctccctaccgcagaggctggggcgggccgggcgccctgggaggaggcggtgtccctggctccctgcccaccggtgcagggctggacgggcaggggcggagccatgcctggtgttataagaggcagccagggcaccgaggcaatgagctgtcgctcagcttggcagcaggacgctggcagcaggcacactccgcactccagcccagcctgagcgtgcctcaccactgtggtcgccatgcccaccgccttgtgctccatcgctctagccctgctcgtggccctgcacgaaggtgagcaccccccacgggctcagcagctgcagcagccccgaggctgcttgtctgtatctcctgctggggctctgtgccccccaagccagccgggggccttcaggggcaggagttaggtggcttgggggctgcaggaggctgtgctattagaggtgctgccgtcccaggacagccaccggtccttccaacccagagctgctggggcttccccaggctggcccagggctcctgagcactgagaatgccaacttcctcgattatgcaagaggaggagcccagcgggtcccccatcccagctgtgccaggcgccctgacccacctctccacttttctctccctcctgtgcatgcaggcaagagccaggctgctaccacccccatcccagagcaaccagcgcccttgccccgggcccgaggctcccacctgcggactcgacgttgctcctgcagctcctggctcgacaaggagtgcgtctacttttgccacctggacattatctgggtgaacactcccgggtgagctactggagggatccaagaggggttgcagggggcaggggtggggaatgctggcatgctggggaagccctggcacactgcagctctctcttggagtgtggggctaacaacaatagcaatcagctattgcttcagttctcacgtgggggctgcctgagcaagacagagggctgtctcatgaaaatcctcacaaaaagcctggtcagaaagtgttggctccattttccagatcagggtactgaggctcagagaagttaggtgccttttccaaggtcacacaggaagagtaagtggtaggtaggaggctccagcctaggtctgcagatgccagagcgcacagcggctctgccatgctgcctctgtataatcttccaagaatgatatgattaatgacagcacccatgtcttgactgcgccaggccctatgccaagcactgctggtgcgttatcacctcgtgaacgcacccccatcctccccagtgaagcggggactgctgctgtccccaaatgacagacaagagacctgccccatgtcacctggcagagccggggtggggtcccagagctgtctgttctgtctgcacccgcgctgcctccgggccactgcatacttcaagttgaagtttctctgtgtgtttgtattttttttttccttctccaaattgcaaaagacaagagaagcccggcacgtaagcgtgtgtggagctaatccgcatccaaacactggctcagggcgggaaccctgccagtccctgcgtgctgggtctacctggagtctctgcagctccaaccacaccgtctaaaattagctcaggcatccgaggtgctggtctgaccggccacggggccctgcccttcgcctggcccgtctcagccagacggaatctgaaatcgatctcagccaatctaatatatctatgcacacacacgcacacgtgcaggtcaggcacacgcaccattttaaagtcaaaactctaagaaacacttgggtcacccttccaggcaagtggtgaccggatggaggcagctgagctgtgagcctgagtgttcacttctgtgagagggcactctctccctttcttccagactagttgggggtcttctttgagaacagggggaccagcctgactccatcagttcaaattgctgtctgggagtgagaggggcagggaggacagcttccacccctcccccccatgctgagcgtcttactgagcaggaccagggcagttgggagggaacagaggcccgagagggtaagggtcttgcccgaggctccctggcatgtaaggaggaagctgcagtgggaattcttgagggcaggagctggttacttttgctgccaccctggtggcatggatggctatcccagtgtgcagtgtggacagtcccagcttgccaatggtcctggtttatctaatcctctctctgtctctctccaccctacaccactaccttgctggcggcccgcccacagacagacagctccttacggcctgggaaacccgccaagacgccggcgccgctctctgccaagacgctgtgagtgctacagtgccagggaccccgcctgtgccaccttctgccatcaaaggccctggtaagtgggcacccagcctgcaaggggccagaggtgactgctggcctggacctgctctggagggcagggtgtctggaaggccagcagtggcggactgttagtccctaggtcgtgcccgactgtttgtgaccccacggactgtagcctgccaggctcctctgtctatgggattctccaggcaagaataccggagtgaattgccattcccttctccagggtgtccaggaggccagcagaggcgtggctaaatggtggaggaggggccaggggagcagggtcctgggggtccagaggctgccctgggctgtggggcagcctcccttcctgcagggagccagtcacccttgagtcttcccccctgccactacccccagctctgggggcttctgagaccattgcgtccccactcctgggcaggaggaatcctccccaggtgatagctgaggcagcacaggtccagagaggaaacaggacttgtcctgtcaggctacacagccagttagacgagagctgggccttccgccttagtcgctggggctctgggacctctggaactttctcagtggagaagcagtagctggagttggggggccatggcaccgtccccgagctgccacaaagcgcctttgccagtcttttggccctctggacctccctccctccacgcggagcgttgggaaagcagacagtgacttcaccctcccctacctcccgctctcatgaaggcctatgggaaactcctcccctgagacctcagctgtggctgcagccctgcctcagtttccctgctgagggttctgcttggctgcaagtggccagactctgggaaggccagccaccccactgcctctttctgaggctgagaacgcattcccagtggctcagttttcctcaggccccaccccacctgggaaaagaagggtgccaggtgcacagggtggaaatggatctgctcctgagggcgggtcggggcggggggctgggctgggcctgcagccaggcagcctgggggccctggacagcccctcacttgggccctaatgctgttcactcaggactgatgcggtggcagtcccaggcagcgggtcccctgcagctgcgttccaggatggcaagacacaggccacagcaggagagctcctccagcggctgaggtgaggggcccctacactgattgagtgccttctgtatgccttgcacatttcccttattctccatatgacgccttgggtccttatggggcagccaatagcagctcagacagatgaaggtgtttacccaaggtcacagagcaagctacagcatctggctgactcaatagcctgtgttcttaaccactatgctctttgttaccgccaggcctggaagtggacttttattgagggtttcaaggcttgtgactgtggaaggttcccaggtgttcattcaggctgtgtctgaatcaagcatctcccacatgctggggtccaaacggatgctacccagcctgttccctccctgggtcccagactggactgtctccctggtagctacaacatggctcagctcaaggcttggcatccaggaggtgcccatgaacgtgtgtccaaccaaactgacttgagaacagaaacctatagccagtcatgtggcagggtggctgaaggggcagcatctgagctagaaagtcccagccctgccacgagcaagctttgtgaccttggtctgctcactgaacttctctgtgcttctggttcctgtctgtgaggcagggacaccgctgctatccatctcacgggcttgttgaagtttagagcagttgacatacatgaagagccccaagaaagcccaggccctacgggagctctgaaggttttagccatcccgaacctctgtccctgagggttcctcagggctgcccagggccggggtgcagcctagcccctcaagggtccacatctctgtgaggaggcggaaacataggcaaaaagacaggatggccggctaggcaggacccaggatatactgaggaactatcttaaaaaaataataataaaatgaaagtgttagtcactcagtcgtgtctgactctttgcaaccccatggactatagctcaccagactcctctgtccatggaattctccaggcaagaatactggagtgggtagccattcctttctccagaaaatcttcccaacccagggatcaaacctgggtgccccgcattgcaggcagattctttatcatctgagccactagggaaacccaggaaatgtcttaagatgaaaaacttcaaggtaagactttgcaagtacttggcattccataattagcaaagagtgttttcgccagtctgtactcagcctcacaccagttcaggcctgtgtttattttacagaccaagaagggggttcagagaggttgagacccttgcccaagttcccaaagctgggaaccagcctcccagttcccaggctagaacgccttaagccagagtgaggccacctagatgacggcagagcccctaccagggtctcagccagattcaaaggactgctaggatccatacatatctggagctggaccttgaagaatgggaattttagggcacggagtatggggtgagtggaaggtcaacagcctgaagagccacagggatagaggtgtggaagtgagagggcaatcaggggagagccacggggctactcttggccgtgcagtcaccctggtggcacttgatgttgagcatcaattttgtcaaagctccttgtgggcagaaaagcttctaacctgccccggcctctccttgaggttcagaccttgttttcagggttggctgtgaccaccctctgacctcttggccatgaataaggaatccagaccctatgaccgctgcctctcatggggaactctcaagtgatgtatatctccagagatgctcaattgacctctttccatttcagggttatttctgcaaccaagatccactttgctaggcaacagcagaagccgacgagggagaccagacctacacactccaggcagaggaagagatagctctcgactctgggagaactttgggaaggaagcctgtgtggatacaggaggagaggggcatcccagagctgggagaccttccgacctgtttcctgggccagaaaacccagctgctggagcaggcacaagctctggcctcctcgccctggggagggggcctcgctcaaggcagctccgtgacaccaggaaagtcatcaggccccaggctgcagcgtggcctcccacactggctccagttcctaggccctgctgaaaggaacggcatgcggaatgtgctagcctggaggtgtcctgtctggcggctgtgaaccaggaacaacgtgcagtggcgggcactcacacccaagccagcccgagtccttccagggttgaagtcccggccgcccccgacccctcacccccgctctgtcccctccagccctcgctctccagtgtccttattctcccttcataccctcggggcactcttggtgagaagggcctgcaccacttcacctgtctgtatataacttatttgctctaagaaatttgacgattccgattatttattttaacgtatttttttagactctcaattatttacctgcgaacttgtgtttgtaataaacaacaaaataatgctctagcatttggtcttggttgagcaggaggtgggaggcacttttcaggaaggggctacttagaagtgaagggaacaaagggacggcggggaaagagcctgaggcaggtgtggagcactgagttccacacccctgtgccccggctgggcatcgctggctgctgacccaccctctctggacttttgcctatcatgtgcctagacagccatttgcagctttgatatcccgggttccaggacctgtgtttctatcaggccggtaagtgttggccaggcctttccccagagcatgtttcataggagccaagactataaggacccacttctgctctggttgccacccctgaggttcagagcaaacctgtccagtgagggctgtgtgctgttccaagactgtgtgcagccttactggccagggatggctgttgtaacggagtcacaggctggtccttatccctcaccctgggcttggacagaccccgctgggggcgctcaacacttctctcactaaagaagcccagggctctagcactggcttggctgatcctgccaaggccccaggaagctgctcacctgagtcccagggacagccagaagctacccccgctggcagctcctgagacctacagcctccactgctgccaaatccccctgcgaacaaactgttccctttcccctggccggcctctgctgggaatggtacgctgtggcctgagccagttattgaaaaataattatttacacactactctaagcctgccttgtccatggagccagccccaactccctcctgggagaagaacatgttgacgcatattgaactcctactgtttgctggcattttatgcagataaactcacttcatcctcatgacaatcccatgatatagatacttttattatccccattttacagatgaggaaactaatgcacagagaaggcaactaattttcctggggtctcgcagcaagtaagtggtagcatcaggatttgaacccagagtgtatagtacacatgtctatatgtactgactaaatatttgttgattgaattcatggattaccactgtagtatgacattgaacaaatcttcctctttctgagcctcagttttttaatctataaaatgggaaacagtactttccactttgtagagctggttgtgaaccctaaatggatgagttatggtgctgggctcagtcctgggcctgatgagaggcaaagccgaatgtcaggccgttagaagtgatgatgtaacaagagggacaggcacaaagctgcaggacctaagttggggggagattggggctggctggtgtgcagaggcatggtcagagaaagatgcacgactaaggtgccactcccacagcctaaggagagtgagactcacatcaatagaaggaaagtgaagagggagccccagacagagcagacaggaagggtaaaaggttttggcaatgggagtgacaaaggggtttcccatggaggaccccatgtggctggagcatggtggggagagagcagcaggagaggaaaccaggactccctggaggccaaagtagggagcctgcactttctctcatgggccatggggaccctcgaaaggtctgtgggcagcagggacctggtaaagccagactttgaaaaaatgccagagggccacacagggggaccctgaatggggagacagaaggcagggaagcaagtcaaccgctggtccttagggatccagcctgggtggctggggttggcgatggagccacacagtcacttcctacccaggattccggcacacctctgaaatctcactgagcctaacgccaggtgaatctcactccccagcatcctgttcaaaataaccctgcccccacggaaatcccaaagcaacggccaacagtcaggctaggcagtgatgtggggcaaccccagcatggcaggagtgatcgagaccaggtagaggaatgtaggttgaaggtgtgtccgaggcccagggaattaggcattcactgccctggtcagagttcagagatcagcgaccaaatgattaagtaagagacaattagagggaggcccagaaggcaggtgaaggcaaggcgataccataacccccaggatccttactctcaagaaatgggggcccctggcttgggccctgcactctagccctctgccagccatatctttctctccaaataagaagtttgcagggtgaagggtcatgaatacccaaagtctgagcctgcttctaaaccacattccatgcagcaggggcctcagaagtgtgggggaaggtgggatagagtttggaagaagcagaggaaaatttatgaagaactgttgccaaatcaaactgaaccctgggaagaaaggtgtcaacattttagaaagcatatctggattttatgggacaaaatcgtccctttttcctgcctttttctgccttttccataaatacttacaggtttggtttaggctttctgagttaaacttgtgttccttttaactggaacaccaggcggagataggccagaagggggcacagggtgacccagatttattcgggtcatgtgcatgcatggaagcagagtcagaggggagtggagttccatgtccaggactgtgcagcctgatacatatccaggctacagactggccctttcctgtcctggactgcctctccctccactctctcattcagcaaagaaccccaaggaactagtttcactcttgccatctcactctctctctgaacctcagggatttcaattgagaaaagtcatttgcctatcagggcaatgaatcattggagtgtggccatccatgcgttcaacaattatgaacaatcaccgttcagagactcccgtaaacaaggcagacacagcccctgccctcacaggccaagaggagagcctttcaataaagcactgttactatgaaggtagaagtgaaagcatttattgagtgctcatcaagctcttcttgcacatggattctttggatccttgcagcaaccttacacagcaggttctatcatcgctattcccagttgagagaagagataacggaggttaagcagctcacccaaagtctcatggctagcatgtggctgagctgggatttaaatctcaggctctcagcctgtctgctgtcctgctgctctaagcaggtagatccatacatagtgtgattgagcccctcgggtgggagagtctgggaggcttcctggaggaagtgacagttgatcaagagaaggagcgggtggacagagtgttcaggcagggggaacagtgtgtaggaagggagctatattctctgtgcttagtcattcaatcctatttgggacctcttggtctatagtccgttaggctcctctgtccatgggattctccaggcaagaatactggagtgggtagccatgccctcctccaggggatcttcccaacccagcgattgaacccaggtctcctgcattgcaggtggattctttaccagctgagctacccaggaagcccattctcagaccctatcagggaacaaaagaaggaggcatggggaagactggagaggggttgctagcggggtcgggggggtggtgggcatgcggctacaagcagggaaatccacagctgctgtcacctcacccccaatctgtgacagcctcagacaatgtccccctggacaatattgccatgcctgaaacacacctttggatcaaaccgtgcttgcgccccttggggtttccctaggctggcaaggaagacagacaaggcaaagtgaagagacaggaggtggataggttacgggctgcccttccagctgtgtgcccttcctgtctccctgggatctctgctcatttcatcccaggggcgttgtgggttcacagggaaagcttggggaaggagtagggtttgcacacactgggatgagggaaacagccggagcatagaagaatccgaaaagaggcagcaagcctgattggcaagggccaggctgggaacagcatgcagtgccaggaatttgaacttgagtgacggggagccagcgaaggtggctgatcaggggagagagccaggacaggagctggccttgggcagctggcttgtcctcggctcttcctgcctccccggccagtgcttccagctcaagggggccctcccagcccctcgcaggagagacaaagtgtgggccttgcctccgcctgccagggaccggagccaagagccctcagcagctcggaagggggccatgtgcgggcccgccaggagccctggaagaggaatgtggcctaattaattctccaaagctcagagggcctcgccttgtgggagcagctgccaggacaggcctgccaggacgccacaggcccagcccgtctatcattcagtgctcggggacagcaggctggaagcctggagacaggggcccagggggccagccccttgcctccaggtacacacgtgtcctccagccccttaacagaaaatagtgcgataatagtaataatcgccaacaggccttgagggcttaaaggtgtgtcagactctgtgcaaagcctgttatactcacttctcatctattcattacgaaggaccagtgacagggaaactgttaccatctccattttgcagatgaggaaactgagggacagatgggtgaatttccctggccgaaatcctgcaatcaaaaagcacacgcagggaagctaggattgggatgtaggcagcctgggccccacaagcatgttgtcataagcactgctgagccagcccagcgaggacatggaggcccagggtggagcgatacctttcccggggacagtcgactaaaaacaggccctgggacattgaatagggaagaaagaccacacccctgtcctctgcttgaactgcctcctcctgaagtttctcatagggcttttcctgtctcagcccgtaggtcatcctcaaagacatgtgactcgctactccaggcagatgggctggaagaagacatgccgtctccctgggatccctgctcatttcatcccggtggcgctgtggtggctgcactggcagctgggcgaggtggtctcacagcttcctcctagcccgctttccatccgtccacggaacacatcccctccaaggcgggctctgaatggtgcagggacggctgtaccagggccttccaactagaaagtggcagacccaggagaagatgggcacacagactggcccgaagccaagactctgctcttcctcagcagcagagcaggaggagggcagtgcagccacatcgcatcccctctctgggcctcagtttctcatctgctgtatgggcctaagagcattaactgtatagtcttgtcctgcattcatgcaggctaagttgcttcagtcatgtccgactctgtgcgatcctgtggactgtagctccccaggctcctcaatccatgggattctccaggcaagaatactggagtgggttgccatttccttctccagggggtcttcccagcccggggatggaacacatgtttcttacatcttctgcgttggaaggcaggttctctaccactagggccacctgagaagccccatagtcatgtcctggaactcattcatgtgtcaagtactgtccgaagtagtttacttaatttttaaaaattttccaaagcaaggttttttcatagctttgtaacatatcaccataaggctgcaccatatgcatctgttactctgtaggtgtgtattttagtttgtcccatttccctccaatgcaatgtttacatgtgtgctacatttatacacaaattttatattcattcctaattcttttttgctgcatattttttatggagacataatttacaccccataaaatccactcttttaaagtgtacaattcagggtttttttttaaatatattcacagttatacaaccatcaccactatctaattccagaacgtttccatcatcccaaaaagaaacacctcacctgttagcagttgctccccagatctcacttccccggcctctgtacaccacaaatctactttctgtcactatggatttgcctgttctggacattttatatcaatggaatcataacgtacgtggccttttgtgtactgctccgttcacttagcacaatgtcctcaagatttgtctatgttggagcaggtgtcgatacttcacgcttttccatgactgaataatattcccttatagagacagatcaggcttcccgggtggctcagtggttgagaatccccctgacaatgcaggagatgcaggagatgtgggtttgatccctgggtcgggaaaaacccctggagaaggaaatggcaacccactccagtattcttgtctgggaaatctcatgaacagaggagcctggcaggctacagtccatggggttacaaagagttgaacatgacttacaactgaacacacacacacacacagatcacattttgtttatccatttgtctgcgttgtttccactcttttggcttaagcactttactttagccttcagtgaccctatggggaggtgctctcttttcatcatataaacaacaagactgacatccagagagcttaagtaacccatgcaggtcacttagctagtgagcggcggtggtgggctttgccccaagagtctggctgcagagacagtggcctcaaccactgagcatcactttctcttcagtcagagtaagatagtataaatcagcacccacagcaactgtgccaaaagtggtacccacagggcacttaacagagggtggcttttctcagcagcatttctgacactggcagagccagggtctgccaggcagggcctgaagctggagcaagagtgtctggacagccagtgataatagtgactatctcagtacacgggtggttcttccagcaatggggacatctctccacacttggtggggggccgtgggcactgactcctctgctgcacatctctggcctgcaccccagagcccatctctcctcccacctccacctacaaagtcatggctcccctcctgtccccaaggccctgacactgagtaaccgaggcagcattcttgggtgaggtcaaggtcagagctgcagtggaggctgcatggacccttgaatgggtctctgtctcctcaggcctccacctactaaataattagataagaaatcttaatacttccttttttaattacaaagcaatttaaataggacaatatagacacaaaggcttgtggctttaagataatgaaaagactataggaacatctaaaataaaatgtctcttctgggcctcccactccaaggcaacgactctgagagtggggtaaatagccttttttttttctatgggttcagatatatgttttctatctaacgttttagaggtattaaaaataatgcacggcaacataagtttctctactttacaaccttttcttctcacaccaaaggcatctttccagaccaatacaaggcttttaccacctcttaattttaacagctccacgtggcccttgttaaggacaggcagttgtcacttgactgtccacccactgaagccttttggatggcttgcatttcttgttttcataagcacactacagtaagcacctggtttatacatctttgtctgcagaggacagatttttagacacgaaatttctaggtcaaaggatgagcacattttaagtattctgccgagaatgagattccaatttgcattcttgttcccactgggtatgagtgcccttttcctcacaagccttccagcactgggttttatccatctcttatcgtttgctgccctggtagcaaaaccacttcttcataaggaatacgatgtgcaaaagagctttgcttgatgccacccagggtgaggagggtgaggggtctggagatgctccaatgtctcactctgtcccctggtgcaaagaactcctctagggacttccagcactgctctccaggattctgtttggctctagggctctgtctctcagttccactcaggggttggccctcagggagctaagaatggaggaggggctggccagtcttcctgctcagttggccccagcctcccctaatagatgtgtctttgagtaggcgctcctggggacagcatcatcatgggaaagcgtgtgtgcgtgttgggagcggggggactctgggcacctgaacctgcagatgttcctaatgggggagcctggggcatcctggttccctctcagcctgccatccaaactcacgttttggaaaagactgaatctggatcttgcctctgcccaggtcttgctgtgtagacccaggcaggtcactgtcctttctggactccaggctcccggctgccaggctgggggaatccctttacagggtagatgccgaatctgctccctctggagactccacactggccacaccatgcgcatgagtcacccccaagttggcaggctgagggcaggggaggggcatggaggcaagagaagggaggctcgctccagatgactttggtgccacatggtgagtctggcgcagtggagtcttgcctggctaacgtgagtgtgtgagcacaggcacacagggcacaccgacgtgtgaagtgcattcttgtataccgaccggggatcctcctgctcaagtctgggcattcaggtttacagctcaggtgatgagtgtccatacacaatccatgtgtgtgcacattcttgtgcgtgtcaacacatacacgcatgtgtgcctgagtgcccctgagcttgtaaatcttcacctggttgtggctgcctagatgtgtctgcatgaacgtgtgaaagtgttagttgctcagtcatgtctgactctcctctgtccatgggatttcccaggcaagaatattggagtgggctctctggggcattttcccgacccagggatcgaacccttgtctcctgcattgtaggtggattctttactatctgagccaccagggaagcccagatgtgtgtgcacacatgtgcctaaatccgtgtgcatgcgtgagggtgcaggtgagcctgcaggatgtgcgcacacgtctatgattagagattacgggtgtgtgggtgcacaagtgtcacaaacatacacactaatgtgtgcgtttgtgtctgagcacatgtcaaaacacatgcatagagtatccgtagtgtagatggagtgcgtccacatgtatgggtctagaagggcttcagtgtgcatatgggcacagctatgtatgaactattacagtgtaactctgttgaagtgaatacacatgagtgtacatttgcacccaggaggggccacctcagcgtctgcaaactatgacatctcctccagggcccatcccacctggcctggacctctcccctcaacccacactgaggaaccaacagaaggacagtgtcattgctttaattacaggaagactaagtattttagtaattagtaagtcattataaagcttactgcttttaagaacaaaaatggctatattatagatacaaaatgcatatggaatctgaacaagaagcatggaagtgcaggattttccaccccaatctgggtgggagggcttgaagaccaagtatacacagggctcaggaaggcaagggagggagaggccagagcagagagcccctgcctccatttccaaggctgtccacacctgacctccatccctacctccatccagcgagatatcgttctgggcccagagggccccaaccctggcctgagtggaagtcagggagtgagtgtgtcagaccacctctgacagcaaccagtcaaggcaaggcccttctcattctcccttccgtggcctataactctaagatagtcatacctacctgggttttctcaaagaacctcaaaatataacctccaacacgtgcctacctccttcatcctcccagaacaatttctacctcccacccccagctcctgtccttctctcttggcctgcactgcctccttgccacaggtctgacccacaaacttctactcattggtccaaaaccacgcctgtgtcaccacccagctgtacaattgtcatcccagctggactgtgaactcctgaggtagggaaggctcaggcattcttgggtccccagagcccacctcaacctggcacagcttagatatcactcactatctgattttagaaactgagataagaggagaagaaagggagagcccctgggcgcagcaacgtttggtaaacacggcaggtcgttgggtgccccaagactggatgagtcagcctgacccttgccctggaggaggaagaaaaagtgtcatttatcaggctccacctggtgccagcatcagccacacacttgatccccaccacacacctgagaagtaagcaatatttttactcccattttatagatgcagaaactgaccctcacagaaagtgagtcagcagcagagctgggactcaagccttcctgactcagcacttcctacaggctcatccccccaggttctttctctctgnnnnnnnnnnnnnnnnnnnnnnnnnnnnnnnnnnnnnnnnnnnnnnnnnntcctcaggaacagcccttaatcataaaggattggggtggtgggtagatacgccagctcacttgcaccatgggtggagcaactctaaggctgcttccacaccctctcccggaggtctctggaggggctaagccctgtttccacctgttgctcattaacttgtctgtattggctgcgcttcctttctcccttccacatcttttatggatcttagaaccacctcgaaaataaactccatgccctcgaatcttagtccaggtcctctctggggaccccaacccaagaccaaggggcagcagccacagggactgtgagtctgggaaagccagggggacattcttgcaaagaggcctcggccacagaggcccagagacacatgcaggtccagacccatgggatgagccctggcaggcgggaggccagcctgactgcagctccagagctgcacacagtgtcaggctggcgcatgaggacgcaggagcaccagggtaaagagggcacgggtgtgagcacagcagctgatggcaacggggtttatctcagggcccaagaccacacccacacctccctcccttctgcagaaatgggcctggaacacctgtgccctggcaagccctagggtagaccccggctggaaaaccccagggctcccagctggccttctactgctcagcacctctggcctgggtcctggcagagcagggaggctgcctggggaaggtcttagatggcaaatctgtacaattctgtgcctctctgtccttcccattcaagaaatggcacagggccttggtagggccgaggaagtgaatggagggatcccagcacctcagagggcccctgttctctgactctgccaggacatagtttgcacacagaacattagatgtggcatatcttgcttccccacgcttttcagaagagggtgggcttccctgatggcactagtgttaaagaacctgactgccagtgcaggagatgtaagagatgtgggttcaatccttggatcaggaagatcccctggaggaggacatggcattccggtactcttgcctggagaatcccatgaacagaggagcctggtgggctacaggccatggcatcgcgaagagtcagacacgactgaagtgacttagtatgcacgcacattacttaacccagaggaatcaagttctaacggtggaaattcaagcattggaaaagacatggcttgattttaggagttggccttccctcaaatcacaccatgtcaaatctcagacaggcagcatcatgaagcagaaaaggcacaggctgtagagccagacagacctggctcaaatccttggagacagaaaagcccctcatcctgagctttggcttccttggctgtgaaataagttgacagtgtccactggcgggagacctggcttcagtccctgggttgggaagatcccctggagaaggaaaaggctagccactccagtattctggcctggagaatcccatggactgtatagtccatgaggttgcaaagagttggcactactgagcgactttcgctttcactttcactggccccaggtaagcatcttcaatctccttcagtcctcagtctggtgaggaagtaactccagagatgagcagatgggcactaaggcggccaactcctgctcaggtgggtccagagtgattcagaagcctgctgccccctgccaggggcctctgaggctgggctgtgccctgtccacttcaccctccccctgtgtggcccagccctgacccgagactcacccactgcccggtttcggcacctggcccacagttagccagggctgggtcttcagtatcaacattcctctgggataaatacctttggcctcaggaatgctgggaactgggccaagaggtcaaagggcctggactttatcctgagaagctcttaaagcctcacagcacctagacgaggcaggcgtagcccagtcataaagagaaactgagagccactgatttcatccaagaaaagaaaccaggggcctccttggttatcctccataagaatcaggacagcagaagatgaaaaaaatggactcaaagcaagcaacagactggaaattccacttctgggtatttaccccaaaggagtgcctagatatgttcatctgaagatacatacaaggttgttcacagcagcattgtttataatagtctcatactaagtgaagtaagccacaaacagaaagacaaatatatgattttccttatatggggtataagtgataccccatatatcgcttatacaaatgataaaaatgaacttatttgatgaaaaaaatgatacaaatgaacttctttgcaaaaccgaaacagactcacagagaacaaactatggtcactggagggaggagttggacatcagcatgtacacactgccgtgtttaaaataaataaccaacagggacctggtgtatagcacaaagaattctgctcaatacagtaataacctaaatgagaaaagaatttgagaaagaatagatgtatatatatgggcaactaaatcactttgctttacatttcaaactaacacaacattgttaaataactataggtaggtaggtagatttagttgctaagtggtgaccgaatcttgcctgccaggttcctctgtccatgggattctccaggcaagaatactggagtgggttgccatttccttctccagggatcttcccgacccaagaattgaacctgagtctcctgcactgcagtcagattctttatcaactgtgctatgagggaagaaaactccttaatgtaattaactatagttaacataattagtgagtgaagtgaaaattgctcagtcacgtctgactctttgcaactccgtggactatacagtccatgaaattctccaggcaagaatactggagtgggtagcctttcctttctccaagggatcttcccttaactagaagttaattaactaattagaagtaaatataattaactatactccaatataaaatttaaatatatactagaatgttcatagcagcactgtttataatagtctcaaactggaaactatgcaaaagggcagcaacagtagaatgaataagtaaattgatccctggtggctcagatggtaaagaatctgcctgcaatgcaggagacctggattcaatccttgggtcaggaagatcccctggagaggggaagggcaacaaactccagtatttttgcatggagaattccacagacagaggagcctggtggggtccttggggtcaaaaagagttggatacaactgagcaactaacactttctttcttcagattgaactacaactgataaaatcatacggatgatcttacaaatgaaacaagattccatcctttaagattccgtatgtctatatctatatccatgtatatctatatatctccagttttagtggtgccagaactcagcaaagtgatttcccttgggggaatgagggcaggcagtgactgaaagggaactggaagggagcctttggagaagcagtcatgttccattttttgatatagcttcagggtgcatgggtgttcttgttttgggaaaatccttcaagttgtacatttatgatctgtacacttttctatatgaatactatgctcttgaatcttgtgttggaatcttagcgatatgccctcttctacgtatggcctcttttgtgcaacattgtatttttgacattcatccatgttgtgacatgtaacaagatttcttctttttcactgccatgtagtattctattacccgaatagaccacaatgtgttcatccattctactgttgatggaaggtgggttgtttatggtctaggagctattacaaattagtgctgctttgaccattttttgtacctgagttttgatgaataaatgtacatatttctgctaggggtatacctaggggcgggatggctagctcatagaatatatacatcttcagctaacggcaccccactccagtactcttgcctggaaaatcccatggatggaggagcctggtaggctgcattccatggggttgctaagagtcggacacgactgagcaacttcactttcacttttcactttcatgcattggaggaagaaatggcaacctactccagtgttcttgcctggagaatcccagggacagtggggcctggtgggctgcagtctatggggtcgcacagagtcggacacgactgaagcgacttagcagcagcagtaatgctttggaaggaatggtgctaaagctgaaactccagtattttgggcacttcatgagaagagttgactcattggaaaagactctgatgctgggagagattgggggcaggaggagaaggggacgactgaggatgagatggctggatggcatcaccgactcgatggacgtgagtttgagtgaactcagggagttggtgatggacagggaggcctggtgtgctgcgattcatggggtctcaaagagtcggacacaactgagtgactgaactgaattgaactgaactgaatgattttccaaaatgttttaccattttggacttccatcagctgtgtatggcagcctcatattctcactagcacaagcacaagcatgctttgtcttgtagccattcaggcaggtgtgggataatttgcatttccctgctgcctagtgaagttgagcacctgtcttagtttgggttccctaggtggcgaccctgagacaaggatttgagagcaagaagtttcttggcaggtgtgttcgtctcctaaggctgctataacaaaataccatagactggtgtcaaaacaacagacctttattttctcacagttctgaggctagaagaccaaggtcaaggtgccatccacgttcgtttctggagaggcctctcttcctgccttgcagatggttaccttctcaccgagtcctcacatggttgcttctctgtgcatgtatagagaggcggagcaatatttctggtgtgtctttctcttgccttcaatgtaaggacaccattagggcctcaggcttatgacttggtttaaaccttaattatctccctaaagacctgatcaccaaatacagtcacttgggaaggtagggagacgtgattcagtccatcatagcaggcgatcctaggaaaactcacaagggagtgaagaagtgacagcatgcgggaggaggctctggaagtgcgtgtccacaagccagttgccaccctgggcatctggagttgaatcccacggggagattctgagaaaccacgtaaaccacgccctcgagagttatcccactcagggcgccggggaggtggacttctatacatcgactcctgccggtcactggttgaggcctatttcaaagtatgggggtgtggggtgggggcggtgatgttagctccctggtgcctcccaggctcacagaagccctgaggctcggagctgcgggtacacaggccacagcacgtcctcacatgctagtaacggtcgaatcctcacttgagtgaagtggttactcttttgaagctgagttttgaaggatgtatacagatgggccaggcaggagacagcattccagcagagggaacggtgnnnnnnnnnnnnnnnnnnnnnnnnnnnnnnnnnnnnnnnnnnnnnnnnnnggtcttccagggccccccagtcctctgactctcccaaatcctgactatgtactgcaagcaccactgaatgccagaatgtctcccatagccagagacatagacgaagttcccagcagagaggctgcaagccaggtcggggccggagcaaggacaaagggaccagcgttcccagggcaacagaggctcaggccacaggatgggcatcagagaagtcaaggcagatctcaaggttgacattaacaaaggaccttgagctaaggtatggggtcctgaagccctgagaaaggcccacttatactcacccccatgccacctgagttcagactgtgctgatcctcctcagtgtcctcccaggtccgaaaagctgtgcatgtttacactgtctgcagagcctaaaccaggaaggcagagggtcagggagaggcgggcccagggctgtgggcttggatgagaaccccctaaccaccattttgacctgaggggaactgggaagtgggaacctaagacaggtctgagcaggctctgactgctctgcagagctatcagcttggagtccagccacatccagttctgtatccaaataacaggcatctcatctgcagaagtataacctggcagggcccaggcatcgtgagtatctgtcagtccagccacactttggcaagtcatgtcccccctactaatcctgctctgtgtggcttgggtggggcagtctccccacacccaggcggcgggcttgtgaaccatgcctggccaaccatgtccccacccccaggtgccgtgattgactcaaggataaacccaggaccctacccaggccaacaggagtctcccttgagacttttactagcgatgtctggaaactctctcatctgctgagatcctgagctgtaaagaagagatgggaacagctggtggacagcttgcaagatagagaaaatctgcccagaataaaagaaagaaagaaaaaaaaaaaaaaaaaaaggcaggcctagctggaagatggagagagagagaaagagtctttgtggtgtcaattaaacacctgggtgcagcatgtctgaagttcctggactcctcatttgcatgagccaacacatttcctgctgcgtttatgtttcatcatggtttctgatgcttgcagtctgaaaggatctgatgaaaatactgggtgagaacacaaccagtgttcctttctgcaccttcatatctcagagatgtgcacggagtttctttaaaaagggcctttgcgattggaatgttgcagtgaggccaagatccctgtcatgctgcccttctttgccaaatgacaactaactgactcaaagtggagtaaacactgccaacagcttacattcaagagttcaggatgctactcccactggaagacctgtcctggaaagctgccctctgcctgactccccagagtattctggaaggtgcatttttctgaccaacagtcaggattaattactttttcatttgttgaaatatgggggtcagagttatatagacttaagagagagggaagaaaatagtgcatttttgcaactccagcctgaatgggcaatattgcacgttgcacgacttgatttgtttaattcaatgaagctcgacaatccacccaaatgtgtttaaccataggggtttggttaaataaattataatatatggattaaaaaagaagtaaggtagctctgaaatataccatcataaaaatatgtctcatgtatgaagtgttaagtgcactttgcacaatcacacctcaataaagtgaagttttttcaaaaatcaatttgcccaattatatgtataacatatgcccattaaaaaataatacaacagtcctataacttgcaaaagtttgtcatttatatgattaggtgggggaggtgggcaggaaaggaaggcgaaaacaatttgcaattaaagtaactcactctccttggatgattcagtccatgccagctttagttccctatcagagctatttccccttcacaagctatttcccaagacggaaagaagtataagcttgggaggctatgaactagaaacttgggcgtctaagaactagaagctgggatgtctttaggacttcagggaagagttcctccctggcctcacatctctcttgtaagaatgcctcatcctatgggttcagagtctcagttttcatcccagctgccattacctgtgcagcaggcagagcccagggctgattttaaccttgcaaagactgtagacgctccagaagaggagtgctgatcaggatccctgcagtctggctaggacttggggacattgtgaccctgtccagggtcctgactggcaagtgacacaccagaactcagtggctttctgtgtcccctgaggggctgggaaatcaaggcaaccccttcgcatcacacaggagacaagcgtgagactagagggtaccattcctggtcttctctctgcctgaacactctgtagtggcttgaatgctgacccctcagatgatatgtccacatccgaactcctagaacttgtggatgtgaattggccaaagggtctttgcagatacggggctgccctgatagctcagttggtaaagaatccatctacaatgcgggagatcccggttcaattcctgggtcggaaagatcccctggagatgggataggctacccactccagtatcctgttattcccttgtggctcagctagtaaagaatccgcctgcaatgcaggagacctgggttcgatccctggttgggaagatccttggagaaaggaaaggctgcccactccagtattctggtctggagaattccatggactgtacagtttatggggttgaaaagagtcggacacgactagtgactttcactttctttgcagatataattaaattaggtctcaagatgagatcatcctgaattatctggtggggggaggctctaaacccaatgacaagtggcctttcaagagaaagtccaaggaagatgtgacatagaagagatgagagatgactcagaggagaagaatatgtgaagacagaggcaaagactggagtgatggagccatacaaaatgccaccaactaccagacaccagaagaggcaagtaacaggctgccccctagggccggagcatagccctgccagtactgagatttcagacttctggcctccaaaactgtgaaagaataaatttttaaaccacttgttacggcaacccaagaaactcatgcacatttcctgctctcctttctactctactgtgggtatggaccaaatagccctccagacagcatcctacagagttctagaagtgggcagaagtcccctctggggtttctagcttttctacaaccgctcccaggctggggctcagagagaagggtgaggcacaggcagcctcttggcatcactctttcctcctacgaatctgtttttccagctctctaatggctcctctgagaaatggaagctctgcctacattattccgagctgggcaggcatttcaccctgcactgcaccataaattctttctacccgtgccttacagtaaaactccatgttcagtcctccaagtttgcgcctggcatctgcaggaagtcctgggagcagacaactctgctttctctcttatagtaggtgctgctgattctctacccaccttctctttccctgctccatctctttaaaatgacccagttttcattccggagtccatcttgcccttacatcacccacgtgcttcaggtgaggctaaccccaacctcagctctgggggctgctctaactggtggcatggaatctatcccacgtggtccagaaacccaagcctgagtgccagtgcagggcacctctccggccacagaaacaggcatgcaacaccagccatgatgccaagggaaatatactgggacctgctggaaacaggtatttccttgctgttagaaggatccaccagaagggacatgttctccttttcccttggtgtcctggtggtgaatgtctggcaattctgaggggagccaaccccaggatgaagccatcagacagagcatagccaaggggctgctgagttctaggccagagttgctggattaagccagtcctgaagcccaccctgtctctggaatctggttacctgagccaatacatctcattgttgaagccactgtgtcttagacttactgttacctgcatcccaaagcatcttgccaatataccacttgccacagccagttttttaagactactgtcctgttatgggttttgagatcctattttgggagtcaaaagctaactaagcattgttccttattcctcttacattattattgtagcaatttttaatcctccctaaggcagatggatgcctctggctcaataggaggaaaattcacataaggaagcttgagaaaaaatacacgttactgtatttcaaagaaatgatccacattaccctaacattcacacaaaaaacctgggggaagaacttctaaactgtgagcaggagcagctgaagaggacttgggggatatgtgtctccctttctaggctagtatcactgtaatgtttgaatttctagagtaagcatgtattacacttgtaatttaaaatcctgaggattagagtcatctgaggcatccagaattccccaggtaccgtccatggctcagctgtcaatcctgcagaaagtttatttgtggatcagagcaatgacttaagaagaatagtcacaatgtttctttacaatttagactttttgtttcaacagcgtacactgatctagctgagtgcatgttccccgccacaggaaacccttgccaaatctgtgccaagtggtagttaacaggactttggtgtctcctggggtcaggagaggggctgcagctctgagtcagccacagtctgcctcctcccttccaccccaggatctctggcacaaagcgcccatgcctctgtgaggtctgaagggcctccttgcaaactccaatcctgtgtttatgctcctcctgcaagaaggatgccacctcctccttggacagagatgaggaccttcagtatctccagaggggtctccagactctgggggccagagaccacagcccagaccccagtgccccgagagccccctgctctgccccagggtccccgtcactccctaggggttctcttctcggcttagtcctgatgcaatctccaagctcaactggcctgtctctgtcatttcccccaagctgataaagccagaaacctcagagtgagtggaaagagcctctgccctgaccagaagaaaccgcagggctgaccccataccccacagtaagagctggagaggctgggctctgggctcaacgcctggggagaggaggaagaaagatgaaagagctgaagaaaagaccatttgctatcacccgctcacacctgtccaccactctctcttccctggatctttccctgtgcttggtccctggactctgtccctctctaaagcttctggctccaggatcagaaaaagcctcagtgcgagcctcagttctagaatctcaactctcagaaaggctagtatagggggcctcagcactcccctgcccagacatgcctggggtaggtctgggattccttcatgctcacctcctccattaagggctgggcacccactagaaggcatcctgttccccatgggtatccagaaccctcaaatgtcccaaacctcctcatccaccctcacctctgcctggatgggcagtagataccccaggtctcttgccccagtcagacccctatgcaccaggccctgtgctgggcatcaggttcagagatgaggcaggtccctgctgcaggacagtggggggcaggggacagcaggtgggccaatggccagatgaaagcagtcacagtaactgccagctgctcggcccgatgccagctggggacgtgatattgaatggtcacgagccccttccccaacaagcagttcaagttcccagcagtggtctgtacagaagccctcgccagatgcagcatcgctcagagaggtcctcctggttcgcaggatttaacaagtaacccctgctccacggtcctatcgccctctagcattacgtgctcgatttgctcttccagtcacccactcccatcactggagtgtaagctcttggaggcagtatctgggtcattcttacaccccagaccctgggatgctgtctgggcactcacagtgtatttgtgggtactggatgtgcatgaaaggtggttgctggattcttgtccctccttctaccctatcagtcacctagccaaaccacccccaagacctgcagaagctgtctcttctgttctgtcatctctcctcctcgccctccccagactctaaacccagcctccccagcccttccttggtatttcttaatctctaactgctgctgctgctaagtcgcttcagtcatgcccaactctgtgcaaccccatagatagcagcccaccaggctaccccgtccctgggattctccaggcaagaacactggagtgggttgccatttccttctccaatgcgtgaaagtgaaaagtgaaaataaagtcgctcagttgtgtctgactcatagcgaccccatggactgcagcctaccaggctcctccgtccatgggattttccaggcaagagtaatggagtgggttgccatgctttctccgcctaatctgtaagcccagttcaaacgtcacctcctctgtgaagccagctcagatccctttgtgggcacattgcctgtcacatgatcctactgggcgctgcagccacgtgtttatgtgtctgcggcccccgcccccaccaccacctccactgctgaacagaagatcttcagaactgggctggggcccaggtctctgcgtccagggcttctacagagaccagggctgggcataatatcagagctcaggaacgatctgtcagatgaataaaggagtgagtggagaaatgaatggatgagcccccgttagtgagggatacgtgaaggagcaggcggatgcatgaatgagcaagggaagaagctaccgagtgaatgagtcagtgacttggggtgggggggagggggagtgagcctgtgaaggagagagagccgtgagggtttcagtccgctccagcagccctggcagcagccagcccccgccacccctgggcctgagctccgtgccaaccagacctcccgatgcctcctcccagagccagctgccgtcagcaccgctcagcacgcgctcccgatgctggccagcccctgcgctgggccatgaatcagacagggcactgccccagggctcccaggacccggggcagacagacagcctcataaataaacccgatgccctgctgggcagacatgtgttccagcagtgcagtgagctcagggttggctctggagccggggctggcagggcagagcctgatggagaagcctgggagagcctcaggaagagggacctcagggctgggcctggaggagaaagggcacccggggcaggagggctggcagcagccaaggcacagtggcttcgacagacacaggagtgcagggggagggcgtggtggaggtgggaacatggggaacgcagggcctgagtggtggggtcaagaagttgggattggcagagccagggctggggacacagcaggatgtaagcagagtggggcacaaggactgcgggctggcggtgctgtatctcagaaggaaagatgggaggctatggggaacaggtctgtgagtttctagggcgctcagggctgtgtcctgctatagctgttgcataattgagcttctggcttctctccacaaagtcaccatcatcctcccagccctaatactcaccaccagcagcttgaggctttggagcacccaaattagggaggttactttggtgagaacacttccaagtgggtgtttttaagccaagattgttttataatggttcagatcatggggaagatcctggggtttctgaagcaaatcagggaatttcagaatttgacaggaaacctcccagttgaatgggtggaggccaccaattcaaagatgctgagcatcctacagtgcacaggacagcccttcacgacaaagaatgacctagtctaagagatcaatcgtgccatggtgttcaactctttgcaaccccatggactgtaaccctccaggctcctctgtccatgggattctccaaggaagacgactggagcgggttgccattcccttctccagaggatcttcccaactcagggatcaaaccgggtctcctgcatcacaggcagattttttacctctgagccattgggaaagcccagtgtcgaggttaagcaacctgctttcacaggtgggaggactaagacggtgaggatgctagaccaaaaggtggtctccagtaattcacgtgggtcttcatacgtgccaggagctgttctgagaacctacccccattcactcatgtcatctcttcctgctttgaggatgaagattaaagacatatgtgattttcccagggtcacacagctggtgggtggtgaaggcaggattcccacccggattgtctggcttcaaatgctgtgctcttgatcatgacatcccatggtctcccacatcacccagcagctgggacagagctgggcttgggcccagagcccccctctccaggcagatgttccttccactctgctctgggccccaggtccatgtaggagtcttgggctcctccaccaccacagacgtggagcttagcaaccgggactttgatttgtgagggatgcagtgggtgggcaggaggcagatcccagggacagagggcctttgtctgcctgcagatgggcaggggccagttgggtgcaaactcattagacagctgccgaggctgccaaggagacgggagcaattagcgggcttggctgaagccaggaagtggaagccgctctgtgagagctgctgagcctccctgccctccaccaggacccagctccctaggaggcagctgccaagtttatgttcagtttgataatggcagctccaaccatccttacaggttgaacctactatgtgctgggctaggcacattccatatcttgtcttttttcatctataatcacccccacccaccttgggaggctggaatgactaactccattgcatccacttagtcatccttccattcattcgacaggtattcatttattgggtgcctactatgtgccagctctgtgctaggtcccagagatgcagcagccaacacagcagacaaaagtctccactccagtggaccttctgttctggaaggggaagacaggcaacaacaaaaaagaaacaaacaaggtaactgcaacttgtgatcagggctatggaggaagtgaaggggctgatgggaggatgctggggataaaggaatcagggaagctctctctaaggaggtgacagttcacaggggagggacttgggctccgagaggaaaggtgacttttccaaggtcacacagctggaaggtggaggagctagggcttgcctccagccttgacctgggcacctgcctcacaggagcccctgcccctccaccaggccaccatccacagctgtgccacacactggcaccgtatctccaccccttcctcatggcagcctcatgaaattcgtggggttatcacctccatcttacaggtggagaagaggcccagagggggccttcacaaacccagggccctgcaaaggaatgacagacaaggggcttgagcgtcttttgatccccaaacctgtattccttctgccacacctccatccttcctggccaagcacttgacgcgcactgagcgtttagtaggccgataagaaacagatggatgcatggactatggggccttgggcatcatctcctttcagtgcttccatttctccattagagaaggcgagagggtccagaccagcttcaaaatgcccaagttcattctactctgttgacattccttgaggagcgtggtcccctatggagaaaaagatgaaagggactctgcctcccgcagactattctgggcggagcaaactgcaggcagaagcatggaggtgggaaaggaaatggcgaggagtcagcagacatgtttaggacgcggagagccacctggaactcatatctaagtgtccctttccttttcctgcattcttaccacctgtcacctgcatagggtcttaggccaccagagcttcatctcctctcaattccagctcttgcttgagtcccagagagtctcccagaggaggggctgaagcagatcccaaatatatctgtgccaccaactgtgcacagtgtgatcttggtcaggcagctggtcccctccctcagccttggtcttcctatcgattaactggggagacagtgatcagagcaagtcggtagcacaataaaaggtgaggtttatgagcacattctccatgtcaggcagtcatcccttgagacaggcaattttgttatccctgatgtacagataagagatctgaggcttagggaggtgaagtcactggcccagggccacacactaggaaatggctcccccgggggattcacgcccaggtccatctgatgccagagctctgctcataacaaaaagctcatatgaagcaatgccctgccctttgacccacgcaacactcaacccccaggactttactcgtaggaaataatccaagagagccaaaaacctgttcacagcgggcctatttacagtatggcagatcactggaagaaatctgcatgcccaacgacagggctctgttcactttagaaattaggcagcttcagatggactgtggcttactgagcaccagctcttgccagttgctccactgtaacccccaccctaaccctgcaaagtggatgttgctttctgcatcctgggtgaggcctccaagttcagagtgtgaaggattggctgagggctcacagccagtgttgggccagggcatgagtggtgtggccaggcctgttcacagccacaccccaggtagctctgttctacaagaaaggaagctaaggcaagtaagtgacccagtaccacacggctgataagcagagaactggagtttgaccacaggaactgggactgcatactctgggaccacttccccacactgccacctactgactgggaaactgcaggcgagtcatttaccattcccaagcctcctgggctcctcatctgtaaaatgagaataagattgtctgttgcgcatggtgtcaccatgtaagcagtggtaaagatagcaatggcaacactggtaatactgctattcacagtcgataccaccgggacagcgttctgccgtgaaaggaaaccttgcctgaacgttagaaggactggctgcaaacctcagctaggacacgtctcaactctctctgggcctcagtttctccatctgtaaaatgggggagggcacacttgagcatgtctccggctctggtggtctctgagcccaggaacactgctatctcgggttttccctgggactctgcctgctgacccctcatcacacactggtctgggggagcgggggcgggacgcagtgggtctgggcttgaggacacatgtactggaggaggacaaggggcccttggacagggaaatggaggttaagtcaggaagccccaacactcagcccctcaacacacagcccctgctcctggcctaagggccactcaggcagcatctgctctaggtcctttgtacctctgcatgggacctgcctctgccccacggcctcagtctctcccctccctgccagcccctcaaggagatgctgaaccttggtgaagagaaagcagaggaaggcaaggaaggaaaggctgaggggaccaggagaagaggagaaagcaccctgagaaggaggggtgaagagcatggttttacataatggatggtaggggtgggatgagaacgaggcttgggacggggtagggaggaagaagaagaggtcaacagaggggctgagagggtctctgacatttttcagagttccctttaccaaccctggtgaccttcgggtgccctctctttatgtcctgctgactggatacactgggagccaggcctttcacagaggtcatgccagccctgagggcaggcctcccacatggctccagccccataggcggccacacagaagggccaagggatgtttgcgggacaaaggacttggttcactctcccaaaggctctgaactgagaagaatgtagacatcatccaatccacctttcctcacctgccgccccaccccacccccaccaagggaggaaggactttctcagggctccaaggtggggatgtcgatgtcagggccagaaccggaacccagtgtcctgtgtcttgggcctttctccagcccagccctggagggtcccagcagcaggaagaatccctgcctctggttctggcttaataaccagccacgaggcggggctcagggcctgcggctcagctgccagtctccccaggttgcaagagcattaaatggcctcagtgatgcacagctttgactcctgagcaggcgaggctggtggcagagaatacactgatgtgacatctgggggctcctgggagcctgagccccggacaaacctccaccagcgtctgaggaacctcaggctctgcagagtcagtggcacagaggcccgcagcatccttggaattgaggcctggtgtggcagaaagaggagaggccagatgacccaccgagataccccagaggcagcaaagctgagagacacagccagctgcaggttaagagctttcaaaaactttcagctacagccaaagacaggagatcagtttgtaaacagacaacaaaatcccacaacaccctcagatatgtcctaactcatctctctgatgggctcagagctggagctggcctgctcagattcctcatccctttccaagaaaggggcagcctagccttggacttggagaggccaatgccttcctcaggccagttcttctattccctccccatccaaatgcatcaacaaatcccctctgggtttattttcttccctccttccctgcaggactccagcctcatcccatcagtggtgctcacccttcctcccaaaccctccctggctccccatgtcaacaaggtggcattcagactacttgacttgacattcaagtgtgatctgctctctgacctcaaaccctactgctcccctctgccccaaccatgactctcagtcttgggatgttcttgccacaggaactgcacattccaatctggtagtgggcatgcttttcctctgaatgcaggtgacccatgcgtctgccccaatcagtggggccatggtagaggggactctcaaccctaccacttcctggaagtgtgaccttggggaagggagtctcacttttctcatctgcaaaatgggaatgctgatcccttcacgggattcaaaggtctgggcacagtgcagatcacagaactattattagctattatttagctattattggattccctgatagctcagttgataaagaatccacctgcaatgcaggagaccccagtacaattcctggatcaggaagatctgctggagaagggataagctacccactccagtattcttgggcttcccttatgactcagctggtaaagaatcctcctgcaacgcgggagacctgggtttgatccctagttgggaagatcccctggaaaaggctacccactccagtattctggcctggagaattccacggactgtatagtccatgggtcgcaaagagtcagacatgactgagcgactttcactttcactttagctattatttatcaggatcagtgctgttattacttcgtgcggtcccacacagcaaacatcctaagcaccgggccactggcaggccccaagtctgtcaaactaacctcacatgataatattagaaacactcgcctccatctcaacttgcatatgtgaaactgaggcccaggggcccaaagcccagctaacagcagaacagaccagaagccacatctcctgatttccaagccagaactctttccctacaagctgccactactaaaagccgagttcagacgccaaactttaattgtgatagtctcagtttatacaagaagaaaaacctttgctccatataagaatctttattatttattctcacttttaatgccccaccttgaacattcctatgtaccttcagagaacacccccctcctcctcctcctaggcaaagctcactcctccagctgctctttctccccacctcttttctctctccatccctggggaagcctttatctgaccttccctggcggagccaaagggcaaatgctggcttgcctttttgctgctcagctaaaaagctgactgccttttctcactttctggattgtgttgttgttcttagcctcaagggtctaccctgtaagagaaaaccagaacctccctctccaaagcctttatctattcccagttcctcccatcttaaaaaacaaccagggaccagacaaagcaaaccttcttctaccctcttctccttcagtctggcccggtttcttggtggtgacctgttatctccaggctccatctccttggcttcatctcctactcgccaacccatggggttgcctctgctgtgtcttctgttcaggtctgcagcgactccatttcccccaggtgtgctgggctctgggtagccttcaatctgcctgatctgtctgcctcagtttcctctctgagcgctgtctcctgggggttgtctgacactgtctccccacagccctgccagtaacttctcaatgccctttgttgggctcctcctccatccaagccttgacattctgtcttgggtcctcttgtcttcccatgctccttcccttggcctccttataggctgaatttccatctctagccaatgattgctagagtccacctccagcccaaacttttctcctgaggcccaggcctgggcaccctgttgcctctactggatgtctcttgtctttttaatgattatttatttgtttatttggctgcactgggtcctag

SEQ ID NO: 47 - DNA, 83049 bp, Bos taurus
  unsure (51703)..(51754): sequence is unknown
  misc_feature (51704)..(51753): n is a, c, g, or t
  unsure (57347)..(57398): sequence is unknown
  misc_feature (57348)..(57397): n is a, c, g, or t
gcctctctggtcattctgctcccagctgccaggaggtcatgcccttggcctcccttcacctgacagctccaccccgcagttttttatctacatcctcttgcatgcccgactgtcatccatttgctgagtgctgagctgtttgaaagcacaaatgctgggctttctggtcccggtgcagcttggcatagtggggtccagagaagcatggttgtaccagtgacctgagtcagctcatgtgtccagctctcttagttagtagttgagtggatgctgacatgagcgtagtgttgggccagcaggacccaaaccctcaggatcctgccaggtgggcgagatgttagcggagctctccccagagtcctgattgctgccaacttcagagatgcccaaactaggtctgtgtcctgttagagctgaccccgctggtggggctgccccagcagaagtcagaccaggaggctggtatttcagagctctactctcctccccagctgggagcaccaggggttctacaagcaccttctctggacatgagtggctgggaagaggccctctccgcaggctgaggtcagcttagccaaaccttccaagggaacagggcctgccacctgccagatgctattgtgccaggcatcagcagcgtggccacagtggcaggtgtgtatgtgaactgaccgtgcccagtgctgctggccccgccagcatggctgctgtattccagaataatagatgtctccatgaatgcgctgagtggctacagttattaatatttgagcccttgatatgtgccaggcttgtgtttcctcctcctagcaaaccttatgagatgagactgtcatattcatttgacaaagatggagacagaggcccagcagagtgacttaacttgctcttggtgaagccaggactgaatactaaccaaaaagaaaaagaaagggaaggcctgtcttgtttgctgtggtttgatgccagccttactacttactttgcctgggcaaggtaaggtgaactgtctcatcttagttccctgtctgtaacatgaagataggaatagtgcctaccgggcaggattatttgtggattaggtgaattaacgcacatgcaggccctagagctgaaccttaacatggtagatacgaagtcatttttgctgtttacaaagtgctcccataccctcaacgatcttggccgtcaggcggggtttgtggcacagagcagcgtggggtgcggctgtaacctcgggcctcctgtgtctgtccctcaggaaccagtgatgacccattccaggactcggaagggcgagagggcgcagaggccgtggcagagcaccagttttcagacctggacgactcggactcggactcggacctggacgaagacgaggatgaggacgaggaggagagccaggacgagccatcaggcccgtcctcggaggcgcccccacctggcccgccagccacgctgcccgcagactcctcacccgttcagggccctcagcccacagaggccacccggggcagctcggtctcagaagccgagcgctcggcacccagcagctgctccacatccagccaaagcatcctgtgcctcccccggctggcaccggccccccggggcccagtggagaaggacacaggctcggccctgagctcccaggccctgtccccaaggaggccgtggtccccaagcaaagaagcaggcagccacctaccactcaccccaaaacactcactaaccaaaagctactcgtctccccagcgacattcaccggcccgagagccactggcctcagccccgagtccgcctggctcccagacgggccctctcccctgcgggtccccgagactcgagctgtcgcctcttgccctccaccccctgggaagggaactgccacttcgagcgcgcctgccccccgaacgcaagggcgctgcagacccaggcccccccagacactcgcccaccaggagatggtctccaggccaggccgagtcaccaccacggtcagcgctgccagggaagtgggccttggcagggccgggcagccccttggcggccgagcgtggcccaggctcagggctggccccccgggctctctacccgcccgcgcctctacctcacaagcttctcggcagaagcccagcggagacctgcacctccacatgggtgagttcctgtcccccaagtggctgatgggtggggggccgcgagctcacacctccctgagcgtcacacccagagctggacccctgccagttcagcggttaccaataaggcgtgcattgggcaccacttacacaggcactgtgctgggtgcctgaaaccagtcagctgtgtgtcagaagcagcggagcatggactgtggagctggactaaaagaaagtgaaagtggaagtgttagttgcacagtcatgtccaactctatggactgtagccggccagactcctctgtccatggaattcttcaggcaaaaatactgaaatgggttgccatgcccttctccagaggatcttcccatccctgggatcgaatccaggtcttcagcatcacaggcagattctttaccatctgagccaccagggactacctgatagtttttaaattctggactacccagaattaaatccgggttctgtcacttacgagccgtgtggctttagatgtggtataaacactcatgccatctcctcccaccccatttccacgtattctttgagcagatggcagagcccaacccaaatctccacatctccaacatgactgccaccagcaccctccgagtcacttgagccagctccttcccatcttcccatcagcaccgtcactgtcacatcatcagtgccatctgccatcagtacactccagccaccccataggcttgatcaccgtggtcacaacatcactgccaccaccacggtcacgatccccagcactgacacgttatcatcatcggcttacttttcctctcccaacaccttttctgtcactggagtgtcacgacccaacatctctgctcaccgccagcagtgtcagcaccatcactcaagcgattcaagctccaggagtagtaccatccaggaatcttaacttggtttttaatttggggctcaagttaaaattcctggtggtgaaaaagtgaaagtcgctcagttgtatccgactctttgtgactccatggactgtgtagaattctccaggccagaatactggagtgggtagcctttcccttcaggggatcttcccgacccagggatcgaacccaggtctcccgcattgcaggcggattcttggtggtgggaggaggttaagagcctggggtgggaactcatgttcaagggtaaagttgggtcagtattgtctgaggaacaagagaggcagcagaagcaagagagagggccagcgcacagaagccaacagaaggggcagctccattctctgaaaacgaacgcgctggccagaagcgtggggaccttggttcctgagtgtgcctatggccactatagggctggagatggcccattccagagagggcacccacccagggtgccaccgttggcaagggttgggactcaatggtggcccagctcagctaggacctgctctgtgatctcgccaagccccctcctcactctagtcctcagggtctccaggtgcccagcaggtaaccctcgccttcctctgtcttcttttctgaccctagcagaaggccgagtcgccaagtccgtcctgttcacctgctcccgctcatcctctcttctcccgacccttctcggccccccatgacttccacggccacagcccggcccggacggagaacatcttcagccacctgcctctgcactcccagcgcttgacccgcgccccgtgccccctgattcccatcggcggaatccagatggtgcaggcccggccgggggcccaccctatcctgctccccgggcccagcgcggcctgggtcagcggtttctcggggggcggaagcgacctgacagggtcccgggaggcccaggagcgaggccgctggagccccaccgagagctcgtcagcctccgtgtcccccgtggccaaggtctccaaattcacactctcctcggagctggaggccagggactaccccacggagagggggaggacgagagggggcctgggcagacctcccgactgggagccccgtgcggcccaagtgcccacagagcccacgccgacgcacagcccccgcacccccccagagacctcaccccgggcacccccaggccaccgggcagagtcccggagcccccacctggagtcaccgcgggtgccggccaaccctgcggcctccgccaccccgccgctggaccgcagcagttccgtgggctgcctggccgagaccgctgctcgcttcccagcccggaggaggaacctctctggggaacccaggaccagtcagggctccccccagccctcgggaagtggggggtccgggacacctccacaccagcccgaggagcgggggccccggagcacttagcctctccctgaccacttcagcatctggtttctggtgtttggcaacagacgtttccagccgacttcctcgagtcatcttgctgtcacgggctccctgtcccatctgttgatctttccaagcagcttctgctcagcccccatctgtcttatcttcccacctcgtatgcagttacctgtgcctttttctatgaccttttgttgcttgaaaagaaacaacacacacacagacataaaaaaaaaaaatcccacgaggagactgaggctgtgaatatttagatgggacctcaccctgggccactgcgatcagcagccccccacaaagctggcaagaggcagtcagttgctgaaagaaaggggatgcactgagggagagacagagaaaaaaaaagaaacttttaaaaatatataagtaaatgtaaaagcaagcactcctatgtacagagtttatggttcctatttattgctgcttcatcccaccccagctagtggcctcccctggctgctagcagaagggtcagcggcccaaggcagagggacaggctgggagactccatgggcaggcccagaaaactccaactttccttttccaaagataaggtaaattttcctaggatttcaacacaaactgtttggagcaggtagaaggtagttgctggttgggtccccagggctcgcagacaccctggtggtctgactcgtgaccccattctggcatttgactcatagacaaatccccccaccccggcacctctactctgcactctgccctcaacctttggactggggaaggagccctgaccacccatctcccggttcctgagcacctgacctcggccttgctctcagggccccagccattgctgcgcctttgttctagtaactacccacaaggctgaagggacaaggcctaacccctgggggtcaagatccaaggtgcattgccttgccattcccaaggccaggcttgggcttcatttcacatttggtccctggggtacaaagggctctatttcctccatgactgggcttttccggtacttagcactggaagtttccaaggactcatttctggacctctttgcagcaggaccagtcctcctattggcgtgtcacacactgtcaggcctctactatccccaggaagtacccagaaccatgactggtgggaactgcccaggcctcctattggttggcttaaatctcttttaaaaaataaaattatatatgtgtatatatacatatatatacatacatatatatatatatatatatatatatatatatatatatatatatatatatagaaagagaatggtgtttgatatttcccctagcctcctattgtccgaggtcatttcaattcttctccaaagcaatcaagaataactagtgcctcatttctcatccccatctcctcctttaagaagctgccctgtgttttctggggcaaaagcctgctttgtaaaaaataataataaatagtaataacatgactagaaattaaaatcccaagttgaaatatagaacttgaactctagcatgtttacccagccctgggatatgtggggttttccccaacctccagaaattcttttcttttgtctctaccagggggagaaagcacaaggaccgtggtcacagcccagccaggctaggtgctaatgccgcagagcagggacctccttggccggtcctcattcctcagccaggctgtatgaatcctgtggccagagggggctcctgggctgttgaagttgcttagacaggacaccataaggtgcagagggctacaccatgcagaggcacctctgtgggctcctacccttgggcgtaattccctcttccaccagttcaggacttttccttccttggactctgctgccaggacaaactagccaggccacctggttcatttccctctggctaagacaaaaaggggacaatagggatgggcttccctgggagggggtggctgggccccagggtgctgaggctagggttaaccagcacttcctggctgcctgacccagggtctgaagctcttggtccccctggaagaaggctaacaagcccagccttggctatgctggcacttgtgggtcctggcagaaagctggaaggagccccggaccccagtcacagccttggccagaggctgggtttttcctcacccttgctttccaaccttaccccagggcaaaggtgagggacatgggaaggtggctgcctaaggactggagacttcaagggccgaggcctgggagctgaataaagggcattgcttcagcccaggcttgaaatcttcctgggcaagatcttccagctcccaacctacagagcagcaaacagggggctctgctagagtagcccctgaccttgggggtagccaggcccctcctccaagccctgccccacagctctccccggggcatcattcctctggtactcagacagcccaactactaaggtttccttcctggagccctagtcatggctggtggtggtcagcaggggagagtcaggcacaggcagaggggatgggggccaggagtcaccagagacccatttctcaatgacagacacaatgtgcaagcaatctggccaaaaggttgttgccctgcacaggcatccagagaaatggacttgatgccacccgcctgggctgtatgtcactgggcatggctctcaccctctctgcctcactcaactcctgctcccccaaacacagagctcccagcccgcacgcacacctgcatgataagggaaagactctcacatcacaccctcctcctgccctgctcccagccactttcacatttccagcctgcctgtgacactgttgtccctgttaagggacacagtggagaaagcagtgcccattgttggcacagacacctgtgcctgttctgctgaaatgtgcaggacagtcattcctgggtacaggctggctctggtcctcgggtgttggcagccttgcgggctggagaccaacttgctggggtttcagagccagctcttgtcatggggattccaagccagccggcccccagttctaccctccaggatgcccttcaccctcaggacaagctcagggtcattctgggcactaacctgttcctctccaaggcaccttttacaagcctacttcccctgccccaccacccaccaaggccccgactactaagaccctccaggaagtcaacagcagcgaactgcccactctcccacctccatcacctccaacttccagacccagcagtcccttcacctctctctgtgttaacaagtctgaaagatttaatttctgggtccaggtagcccctgctccatcctcacccaacccttttgaataagaataatcaagataactaagctgaattgctttctagtcctttctccagacaaaacctcttcaaaataaaagtcctgcctggacagtcgtccttggagacagatctgcagcactgaccaaggggagaaagttcccaaagacctgttccaccaattctgctcctgagtcgtgaatcctgtctgctttccatcagaaaactgcttcggcacttatgatcactttactaagcctagtgttaaaaaaggaagagaaaagaaacagaaaaaagaaatgtataggcaaatgtaagataacacgctctctgtaagatagaaatttgccttttttttttttttccctaaaaggtgtatgtattctgtatgtgaaattgtctgtagagagtttctatgttcttaaatggcaatacattccaaaaatcgtactgtagatatgtacagcaaccacactgggatggggtagttttgcctgtaactttatttaaactccagtttctctacttgcatcttgcaatgtcggtatggtatatatatcagtgcaaaaggaaaaaacaaaaactcccacaggtctaaagcacagagtctgatgtacaaaaagaaaatactgctcagtattgatgtgtgacctttgttgtaaattacatctgtactgtgaatgagaagtttttacaagtataataattgcctttattatagctctggctgagtgttcagcctgaggatattttttaaaaaaaaaacagcacgttggaataaatttgaaaatcccaacagaggcctgcttgcccggctcatgatttttcttagggctgtagaatgtcagagctggaaggacactccgagtcccaagtgctttttctgctacagagaaatcagggccagggaaggcgagtggccaggccatagtcacatagcctgggattccaagggcccggcccttccaggcttggcaggaggcacgggtacatggccatgtggtttggggtctgtattcatttcctagggctgctggatcaaatgaacaaactaaatggcttaaaacagcagaaatgtgttctctcacatttctggaggccagaggtctgaaaccaaggttcctggggaggctctgagggaggatctgggccagacctctgtcctcacttctgggggctgcaggccatccttggcctttggtttgtcatcacagcactctcgtctctgcctctgccttcgttctcgctgccttctctgtgtgctgtctaagggtcctcatcactggacttggggaacacgctcattcaatatgatctcatctctagatctttaactgaagtatatctgcgaacactccttttctgaaggaggtcacacttacatgttccagggtttaggacatggacttacctttgaggggccaccactgagcccctcaaggtaagacctggaatctgatcgtgacagttattcactgcctgtgtgacactgcgcaagttacacaacctctctgggcttctgtttcctgttctgtgaagtggagggtttcctgtgaggattaaatgagagagtatatgtgctaagtgctaaatcacttcagtcgtttccgacttggcgacactgtggactgtatagctcaccaggctccaccatccatggggatcccccaggcaagaatactggagtgggttgctatgccgtcctccaggggatctttctgacccagggatcaaacctgcggctcttatgtctctggcattggcaggcaggttctttaccactagcaccacctgggaagcatgcatacagcatggttaacagaaccttgaatatggtacggcgtcaacaagtgtcctctgagcagacctcacacagggtgctgtggttacaaggatgaaaaagtcaggtataggtccccaccttttgtatgcaacaatgacttgctctgcaccaggcagggactaatcatcagatacaacagtgagcaaatcagacagccctgccttcagagaactttcattctaatgggagaggccgtccttaagcaaataacgacatcatcaattcctcagtcccagtggccgtagttgttgctacaggagagaacaaagctctcacacagagtaagtcctaaaactcctgtgggctctggagcctgggtgggttgtggggagggctgcaggtggaggtggagtggaggggaagccatgataggagcagacagaagaagaggtacgtggacaaatcaagagaggccttcggggtaaaatgctggacacaagtttagcactaagaacctaagagggcctgcttgtttcagcggcaggaggatcattgctgacttggggaaaagccggcctgttccagcgcccagtctgcaggcccttcgtaaacactgccagtgctgaatggattgtggaggcagggggtggaggctggagagtgaggagaagagggaagtggggacggcagacccagacatcctccccaggacctgaggggagggcaggggagagctgggcagcagctggagggcagcaaggcgtccagggaagaacggagatgggaatgaggtggtgagaccccagcctgcttcattaggaggagatgtaagtaccagatgcagaaatttcccccagtgtgacccaagggaagaggtgcaagtgataacagtgaccggaagttgagaacatttccgccacggaattttctctgtcacctgctgagaagggaagaggaagctccagtatggggtagggggtgcggagcgggggtggtgtggactaaagacttgagaaagaaaaggttggaaattgtctttgttcattattccagaggcaggacagttgtggatgaaggcagtgtggaccacacaggcgtgggtgctgggcacaagagatgaaaaggctgggaagcgagtatccatggtgccagtgacctgaatgttcatctctgctgaccacagggctggactggaaacccaggctgtgagctaggcttcataatccaggatatgggctgtcacgctgcagaaacaagcaagccagaaactccagaactgaaaacaatgaaagttgaactttcccctctgccatctgtcccatgtgggtcagcagctgaagtgtactcatcctcatcatttggagacctaggctgctggacgctttatcccgtgttcctgtgacctcagaggcagaagaaaggagagagctgtgaaatgttgcattgacagctaaatgctctacatgggaaaagacatctctcctttcaaatttcacctgccaaagcagatcatattgctgtgcctagtgacagagatgaggaatatgtgtgacagtcacacaaggatacgacttcccagtgtcagaaacacccaagggctgagcagatgtcaatgatgggatgggggcagggacagggcctcatggcatcggcctcaaaggtgctgggtttttacagggagtgaaaaaaataatggtgtgcaaggaggcctggaagaaaatggcccctggcattttgatcatggggtgtggaaggcaaggagcagctgtctgggagcgagtccttggggagatcctgaatttcagtcgagaccagtgggaaagtggaatcccaaaaaggcccaggagaagaagagcacagaatggagccaagtccggcctccagcattttacaagccctatttatagtccttgggcttccttggtggctcagtgaaggaagccacctgccaaggcaggagagataggttcaattcctgggtcgggaagaacacttggaataggaaatggcaacccactccagtattcttgcctaggaaatcccatggccagaggagcctggagggctacagtccatggggtctcgaaagagtcagacatgactgactaaaaacaacaatgtatagttcccaacgacaacccagggagatgagacttacggtccccatttttagagaagaaagtggaagttccaaagagcccccaccaaggacttcctgctaagactctgtgctcccaatgcaaggggtttcagatttgacccctgttcagggaactagatctcacacgccccagctgagagtctccacgccacaacgaaagattccacatgtcataactaaagatccgacaagctgcaaagaagatccaggatcctgagcagatcctggaaagatccactttccaagttacaacaaagactcggtgcagccaaatgaatacaaataaagaaagaaagaaatattaaaaacaaaaggacccccaccagccaaagatgcagggctggttagaggctgtgtgagactgactctagcctgactctggtgcagcgcctctgggagccccaagttcctccctctcatctcctccctgtgctctggccccaggggagccctggatctcagactcttcacctccttctccccaggaacccaggggaagaggcaggcccaggccaaggcttcttcccagcagctgcctggcttctcgcagccatccaggatagccccgtgtgtccccgtgtctgaggctgaaggcgcagggatggaccatcagactcaggggctgggattccagtgctcgagagcatgccaagtgcatgcaaactctctgaagaacctgactccccagcctgctgctggcacccaggcccacctgtcactcacaccaagcctcccatggcctctcgtattcacgaggcaatttcccttttggagtgagggagatagggcacctacttccacttcacagaagaatagatcccaagattgcaccctggcaagtggcagggccaccgacccgggtcacacctgacccagaacctcaggaaggcttgggctgagccttgccactgcccatcagggctgggccttctccctaggcctagaccctctctgggcttaagacctagagaccatgcttactcctagagattcccagggacaaaccacggctggcaggatggcctcagaaggcaggccagcctgagatgggcatgagcagggagaaacaggaagcaaaaagagtcaaataaggatgggggcgactgaggagggagcagcccagggctgccctgcgtgggactcatcactgccatctggcccggggagagacttatcacctcgtcactttgtagaggaggaaggctggggcttggacaggtgatgctgctcataaggccacagtggtcaggggcagagcagagacttaaaaccaggcccacacattcagggagtggttgggactatggaaagggaatctgggcctcttggctacctcttagtcctgaaatctgggttgggggaccccagcagacatatcctttaattccatccagcctcagccactttacagagacccagctaccaacctcccccttttataaatgagaaagttgatgtccagagccgggaagagcttggcccaaggccagagctaggattcccgaaccctcagcagagccacctggaccactccgcccacccctccttaccccaggcccaggttcacctgcccagatctgcctttttaggaaaggaaaggagcagccctggtgggggcaggcgggtgggcaggcagccacgctaatccactagctcccggaggctctggttaccgtggtttggggcccgggcaaccctggctgggagtgccagcccagccaatcggtgctgccgctgagctactctgccagagccatacaaggctttgctgcagccctatcttgagccaccacaggacagccccagcgtcggcagccgccccgcccgggagcctgccagcccggcacgtcctcggactctgcctaatccaacctggaagcaggcagggctgcagcgcacgtgcaccgggcccagggttccccaaggccaggaaggtggcactgccagggcagaggccagaatcggggcaaagacctagccgggcatcggagatcctggctggggtcagggatgagctcaggtctggtccaggctgagctgtatctctctgtaagatgctcttctgttcccatcacccctttggcctgactgactgcttatccttccccattcaccgtggagacggggctcagcacagtgagtatctggtcccttctgaggtcttctcagggtccaagtcccaactactctaacccatccagggtctgaggctgcatgcacctctcagaattggggcgtccatttctaagtgcacgttgtgagcatcaggcacatacagccccccctgtggtctttgggggtccactgtcactgccatggatctgggccttggctgtggaagcaggtggggaccggtgacccctgcccagtggagcccatcccatctgtcagtgcataacacctgagtgttatgaattcacaggacccccgaggagtggaaactattggccctgtttggcaagcaaggaaatcaagtcacagagaagttatttgtctgaaactggagtgtcaggattcagccccagagtggtctgactctagatctctagaaatttccgatcctggagggaccaggggctgccatttacactgaagtgtgaatggaggcgagaaagtcattgtctgagataagaggaccctttctttaaaatatgtatctttttattctttcgttgtttttggctgtgttgggtctccgttgctgtgcacaggattcctctggttgtgacgactggggctactcttggttgtggtgcatgggcttctaacagcggcggcttctcttgcggagcacaggctctagagcgcacgagtctcagtagctgtggtgcacgggcccagttgccctgcagcatatagaatcttcctggaccagggattgaacccgtgccccctgcactggcaggcagattgccaaccgctggactatcagggaagtccaagggtgccctttgttcctgaattgggtagggccaggcccccagtgcacggccattgcccaggccctggtcaggttgcccacgcatgcagcggcccctgcagagcgtcccaggccaccactgtcaattagatttgtcacggaagttcactgggttccaacatccttgtgtgtcctacgtgggccaagttgagctcaaagccaagactgcggtactccccagggccacccggcaggtgagagaaacgtgccgacctggggggtggcaggccaggctggcattaggctctgtttgctcacccaagaaaggaagagataaatatagacacaggattactcagacacagcctgggaaaaccggctccgaacctcgacttcagccctggcccggtctcaccttcacccgcctgccccctcggtgtctgctgccaggcctgccccacctgttcccaggacgccccacctgcaaacttcaggacagccgttcctgcctgccttctgggggcaggacagaaactgaggcccagagagagcagggcacccgcctcacatcccacagcaggttaggagctggtgacgcgagggctgcactgcgggagtcagtttatcaggtccaggcaatgcaccagcccagattcggtttccatatttgtgagatggggacctggtacccccggccctcaacgccctggagcctgcgtgtagggtagagttggagaccacgcagcagaaaggggatgaagctggaggctcaagcacaggaaatgctggcccaagccgcatgtgtagggcttcagcactgggactctggagccaaatggcctgggcttaatatccccctccaccattttcagccaagagatttggggcaagtttcttaacatggtgccacaatttcctcatctctaatataagaataataagaattgttattctatacaataaataatatgtacagtattatttgggcttccctgggcggctcaatggtaaagaatccacctgccaatacaggagacatgggttcgattcccgagtcaggaagattacctggagaaggaaatggcaacccacgccagtattcatgtgcttagtcactcagttgtgtctgactctttgcaacccttttgactgtagtccaccaggctcctctgtccatggaaatcgggggcaagcatactggagtgggttgccatttcctcctccaggggatcttcctgacccagggattgtatcacatctcttgtgtttcctgcattggcaggtgggttctttagcactactgagcaaccagggaagcccaaataatactgtctataatactaaaatcccatggacagaggagcctagtggactatagtcgatggagtcgcaaagaattgaacacaagtatgatgttatatatatgtacatgtatatgtgtacgtatatacacgtacatatatgcacatacacataggtattgatacatatatacatgtagacatgtgtgtctacccacatttgggtctcgcaggaggtgctagtggtaaagaatcctcctgtcaatgcaggagacataagagatgcgggttcaggtccctgggtggggaagatcctctggaggaggggatgccaacccactccagtattcttgctggagaatcccatggacaaaggagcctggtgggctatagtccatagggtcataaggagtcaggcatgactgaagtgacttaccatgcatataggcaccggtattcttgggtgggaaatcccatggacagtggagcctggcgagctacagtctatagggtcacaaagagttggaaatgacttagtgactgagcacgcaggcacatatatgtagatgtattatttacatatcattacaataataatagcctaataacaataccaacctctcagagtgttggggtggattaggtgagattagtacaaagcacttacccagggcctgacacagagcaatgactccacatgcatgtttatgatgatgcagccactggggcaggtgggggcctgggcgcaagaggcgtgggtgggcgtctccaagtctcctgccctccaagggaagagctcagccctgagctctatggtgcgttggtctctcctgcactgtgacccttgcagcagctccctgctctgcctgaaagcttcaagagtcaggcagacatggatttgaaggttggctcccacttacgggcttcccttgtggctcagctagtaaagaatttgcctgcaacgtgggagacatgggttcgatccctgggttgggaagaccccctggagaaggaaaaggctacccactccaggattctggcctggggaatttcatagactgtaagagtcggacaaaactgagtgactttcactttgccaccacttacagactgtgtgaccttgggcaagtaactggccctctccaagcctcaaaatccacttttatccctcttgggattggtgtgagggttaaatgggggaacaagtgcgaaactctcagttcagccaggcaagtggactctctatgcttgagctcatcctgagccccatctcttgtttcctccagtttctctcagtggctatgagctgagcccaggacaggtgcatgaccctctgggtgcatgaccctcacacatgcaagggttctcagttatgggaaacactcaccagcccctacatcatgcatgagctcatgttcctgcccttgggtccctggagccatcagagatccgcaagttccccctgtactcttcatgcactcgtgcatatccacacaggctccctctccacattcctgcacacgcacatgcgtgcatctatggacacacagggcacagctgtgtgcgagctcggagaggctggtgcccacaggtgtgtccctgcacacctcaccagcacgcacgctgccacagtcaggggtgttctagccaggcctgccctagccaggcctgcccctgaggtggccgtcttcacagcagaggaatgcagacagctggggatgctctgccagcggacgtgagggagaggcccaggggaaaccacacgggcaggaatccaggcaggcgttccaggccaaggtggagtcctaaggtgtcaggaagtgcggggggggggggcatgtgcagactctaacttgctccagtctcctctctcatcaccctgtgtcctcagcctctaggacttggaggccaaagggttgcacagaccaccgttctccatccaagacagccagccagctctacctgcacagccttgctgcctagcagagcactgggtctctgggctgcagtggcctggtctcagctagaagggatcattcttggcatagggtctttcttcctcactggggaagaatctatgatcacagaagaatctatggggagaatctatggggagaatctatgacccagaagaatctatgactgcagagatcagcagaagaggagtgggttttttttttcctcatttttattaacatatagttggtttacaatgttgtattagttttcctgtatagcaaagtgaatcagcaatatgtatacatatatcccccctttttcggatttccttcccatttaggtcaccacagcacactgagtagagctccctactccctactactaataagtagattctcattcagttcagttcagttcagtcactcagtcatgtctgactctttgcgaccccatggactgcagcatgctaggcctccctgtccatcaccaactcctggagttcactcaaactcatgttcattgagtcagtgataccatccaaccatctaatcctctgtcatccccttctcctcctgccttcaatctttcccaacatcagggtcttttccaacgagtcatttcttcgcatcaggtggccaaagtattggagtctcagcttcaacatcagtccctccaatgaacactcaggactgatctcctttaggatggactggattggatctccttgtagtccaagggactctcaagagtcttctccaacaccacagttcaaaagcatcaattctttggcgctcagccttcttcacagtccaactctcacatccatacctgactactggaaaaaccatagcgttgactagacagacctttgttagcaaagcaatggctctgcttttcaatatgctatctaggttggtcataactttccttccaagaagtaagcatcttttaatttcatggctgccagtcaccatctgcagtgattttggagcccagaagaataaagtctgacagtgtttccactgtttccccatctatttgccatgaactgatgggactggatgccatgatcttagttttctgaatgttgagctttaagccaactttttccactttcctctttcactttcatcgagaggctctttagttcttcttcactttctgccataagggtggcgtcatctgcatatctgatttctcccagcaatcttgattccagcttgtgcttcttccagcccagtgtttctcatgatgtactctgcattagttatctattttatacatagtatcaatagtgtatatacatcaatcccaatctcccaattcatcccccactctttccccttttggtgtccatacatttgttctctacatctgtgtctctatttccgttttatagatgagatcacctacaccattattttcagattccacacatatatgttaatatgcaatatttgtttttctgacttcactctgtatgacagcctctaggcccatactgtcatcattggctcaagtcagagatgacggagacaatgtggaagtcactagaactcttcaggcaggactcatactgactcagcagccagtgtatgttaggtaaggcacttgcatctagcaactccctgagtgcttacaaaagggcctctgctcccatgtacagatggggaatctgaggggcagaggcggcgtcacctacccagatcccctagctggctgactccagacaccagtacgtaaccactgggccatgcggcctctgtcaaagggcacatctcacaccctggaggagaggtttgcaaatgaggctgaaacactgctggcacatgaaagccactgtcccacatgcaggggcagcccagcccaggtggcagagagggctctcccaggtcacagctacatagagatggcagggggaggctgagagccatccaggcttttggcgtcttctggcagcacacatccctggggaccagctgaagctggggaacatgtcagtgttccaagaaatggcaggcacgaaggtgggacatggcctctgcaagttcagccctggggtggagagaggtcattctccatcttcatacagaaaacatggcctaagagggacagagaccaaaaagttccagaagagactgagcagggagaggggctgccagcggagacctgcctccacttcctgaatctctgaggccagggtgacaagtggtggcctcctgtgaaaggcccccgagccaactaggtccctcaccctccagctctagctatttgctgggtggaactgctggggaggagcatgctaggccctggtgctcaggacctcatggatgagggaaggaagaagggagtcagtgcttgaaaaaagtccatctggggaccttccctatactccactggccacactgcctgccccctgcaggttctgtttacagacctggccatttatttacttgctggggagcaaaaatgggaaaatgacagtgctgtcatgggaggacccggaggcaaatgacatgcccaaggccacacagggcagaggattctgacttgtcacaactgctgcttccaggaacacccagatgcgtagccccaaggcgtcacgctacactcaccggggctgccctggggagccgagcctgccctccaactctctggaagaacagggacccaggcacactgcccccggggcagatgactgcacttctctgcgcctctggttcttcaaacagcaatgccttccactcaaggctgttctcatcatccgacggcatcgaacttagatcaaagcatgacctggcacaaaaagcctctcaggcgcctcccctccgcccgaagtttccaaagacttctctaggcctctgcactccttcccaaggcacagctggacttgagacctcgttgtccagcacgagactcaggggaggaaaacaaaccaagaagccagcgtcaccccacttgtcagctggacagacccgcggtccagagaggggcagtgacttgggggaggcacacaagcaggcaggacttctcccataccagcttcatggagagaacaggccttggaccccacgtagtgtccccaggggaccctgggggtctcgctgtggctaagcggcctctcatcccacccaccggccctgcccccaggggttgccgtcctgtgacccacacagggcgctcgggctgccagggccttttagagtcagagccgctgagacttgggaagggggctggcctccctgaggtctcctggggtccccagcagggcagctaagacctgagtccccagcggcacgtggcggcgctgcccgatcggtgatgtcaggcccaccacacccgggccccagcacgttccttctcagagtcggcagagcagagaacaaagcgtcctgcgcattcttgcacgctgactcatcgcctgcacgtagagccacagcagctgctttgcccaaaattggtcgggaggcgggggcgcgccagacatggcagcctggggtcctctgctcactcacctgctccacactctccaggagcccccagtcccaggatttcccaaaacaggcaggaaagcaagaggcactggggggcatgctgttccccaggatagccagggctaccccctgggggagggctcgtgatcaggcacaggtggcaggctggggataaggcgtagatgcaggcactgcttgtctttgagcctcagtttcctcatctgcaaaatggggatgtgccagttaccattttaagcgtttgatatgagttcttttcccatattcttacaccaaccccaaatggaaatactgttatcatcatcatctcacaggtagggaaactaaggcacagacactgatttgcttgaggtcaggtgctagtgggcttccctggtggctcagtggtaaagaatctgcccacagtgtaggagaggcaggagacatgagttcagtttctgagtggggaggatcctctggaggagagcatggcaacccactccagtattcttgcctggagaatccatggacagagcgtctggtgggctacagtccatgggattgcaaagaattggacacgactgagcactcacccaggcacaagtgctagctagctgcagaggtaggatttaaatatgaattgtaaggttccagaatctgcatgtatcccctatatgctaaaatgcggattgaaatatctggtgcccagcaggtgttctcactgtgccctgacccttggtggttgagcctggtccctcacttcacctcactaaacctctaatccctcacctgtaaggtggggtaactgtgaaggatgccctcaagggattgtcagggaaattacactgaaggttcaagtgtgatctgtggaagaaaaggtagatttggttcaacaagccttcaaaccacctttggtcatctaggccaataccaaagtacagagaggagacgagctatgcctggggtcaccagccaggccaagccatactcgtctgggcctccccaggagtctggggaacacggagttgcctgtactctttgggaaagtgagggagcaggaggggccctgccatattccctctgccagcctggcctctcgcccccgacagcctgatttcagagaaggtggagttctttggatctgtcctgtgtcggggtcagaggcttgccctgagtttgtaggaatgaggtggccaccaggtggctttgttctcagctcttacccaggttgcggtgtcccccatctgaggcttgtctgatagtccagagaaagccctagaaggaattcagcacccctaccaccaccagcccccgagccaggcctggtctgggtcccagcgggtctgggccaccacggcacagatgcgcaggactccactctgtgcgctcagtcgctcagttgtgtctgactctgcaaccccatagactatacatagccaatcaggctcctctgtccatagaacttcccaggtaagaatactggagtgggatgccatttcctgctccagggtgtcttcccattccagagatcgaacccacggctcctgaatctcctgcatcaacaggaggattctctaccactgcgccacctgggaagactccactttaagctcaggaggaggtcagctcgggctgggtgtgcacggcctgtgcactggcctccaagctcctttcatccctgggtcctgcacactctttgctccagctcctagcacgtgccatgctcttccaggtctcccagcctttccccatcccatacctcttgcctggaatgccttctccaccttcagagcctcttttggatgcctcttctgctggaaagccatcctgacctttcaggaagaggcaggcactcattcctctggggtcctgtagctctttgtcctccctctttggccaacagaaagactgacacagaacacacactggcccttatcccatagacccccccccccgctgggtccatattccaagaaaaggccttcaagggccctccccccaaatcccaactgggacagagacccacagacccagcccaggtcttgcagagcaggctcagcctgtctactgcatgatggcaaaaggcacagcaaaggcgcctgaactcccatctcttctgctcctggctgtgtggccttgggcaacgcctgtagcttctctgaacttcttcattcccaggccttgccttgcccacttcccaggcccgtttggaagatcaaatgaatgaaggcagagagaatgcttggcgcgtgggcacagctccccacacagctgtcattatcaccgagtcattattacggacctgccttgtgcctggggggggcggtgcctccaaggctgggcagcaggcgggcaggcaggcgatgaactcagaagcagccgcagcctgggctgactcaggctgaggcactgggagaagtgggtgctttatggtcagcctgagccagcccagctctggccctctcctcctacccccaggcgtcacccaaatctgaggccacaaggccttccaggccctttcagggcctcttatctgggaagataaaggccccctccccttgaatggtggatctattcaaatggcttctgtgtgaccttggcaacagtcaccctctctggaccaggcttggggagttccggggtggggggcaggcagtgacctcaaaaggctcccagtgtgtcttccaggtgcttagtggggggactctcccactgctttgggccccagagggatggctcctgttctctccctccctgacactgacctgctgctgctgctaagtcgcttcagtcgtgtccgactctgtgcaaccccatagacggcagaccaccagactccgccatccctgggatcctccaggcaagaacactggagtgggttgccatttccttctccaatgcatgaaagtgaaaagtgaaagggaagtcgctcagtcgtatccaactcttcgcgaccccatggactgcagcccaccaggttcctccgtccatgggattttccaggcaagagtagtggagtggggtgccattgccttctccaggtgatggaactcccagtatcctccctagagtctggagttattatttttatctgacacataagaaaaatgaggcccagagatcaaaagaccctcacctaaggcagcacagtcaacagccaggacacaggcatgtgaccctgccagggtcttcagggcccacctactgcaatcctctattctcctgtggcctcctggctggcgacggctgcctctctctttccctccctggtggctcagagggtaaagaatcggcctgcaacacaggagacctgggttcaagatcccctggagaaggaaatggctactcactccagtattcttgcctggaaaattccatggacagaggagcctggtgagctacaatccatggaattgcaagagttggacatgaatgagctactaacactctttccctacaccctaggacaccagctctatgccaaggcttggacaacagtcaccaacttatgagatcttcacatgaatgtaagacagaggaggaagtcaaagctcagagagctggaattgcttggcctggtcacacagcacagtggtggctggaggctcagtctcccatacctctgctctgtgccctagaacagctgctaccccaggatggtaggggtttgaccaggcctcagggagcctgcagggcagccctctggtttcacagacaccccctggctatgggtgggccaaagaggaagggtacccatcctgccaggatggacctaccaggcccacctgggcccgacgctccttgccaggctcagatggaagcatgaggtcattgggccatccctgctccctgttggctctcgctgctgtgactcagccctgtcttccccaaacctccttctccagggaactctagcaatggtctggcctggccaggtctgctcccgctgcctgtccaccctctcagggcctcccagcctgagtcaccgctcacctcaccacctggcacaatgctcaccgcataaacagactattcccctcccccaggctcccagggttcctctccctacagcccaggagccaggctgaggggtgggggcacttttcctgctgtccccagacttcggccctgaggtccatccccagaacctactttcagggactctctggccttgataggaaaatctagaattgagattgaggcctcagcccagggctcagactgacctgggctcaaatcccagctccttccttgttaggtgggtgaccttgtacaagatacctccatttgaaggagggcaacagtaaaaccagctgcagcccatgaagatttcctacagcatcaccgaggccaggatcctgcttaaaaatgcaggtggctctagattcaaatggtggtatggcctcgcgtaagccactttgcctctctcagcctcagggtccttacctgcaaaatgggaacgagaggaagagagccctcctgctgtggtgactaaatgtgataagacatgaaaaaggtcaagccgtgtctggcacccagggaccaaacacgggtaaacgtttatgtggataaacggtagctgtaattaaatcttaaagtgacgtgtgcataacacatagctcgtgggaagctgccacatagcacagggagctcagctcagtgctctgtggtaacctagacagtgggatggagggggcaggcagagggagatccaaggaagaggggatatatgtatacatatagctgattcatttcactgtatagcagaaactagcataacattgtaaagcaattataccccaattaaaaaaaaaaaaagtgccaggcgttaagtgatcccaggatggttttaatgaatgatggggagatggagagcaatggtctggctcttcactggatgatggagtagcatcagggaacggcttcccaggttggaaagctccagcatcccctctgcaggttgaccaccccacttcccttagtgggtccagaaggctctctcaagagtctttctggctggggctggcctcacagttttccagtttccaggccactcaagaagcacttcactttacagaggacaaagctgatgctcagacaagggaaggggcttgtctgcagccacccagctggaagctgagcccaagcctgcacttccgtgttccccttcttcccagcctgggagctgcctccctggactggggataccctcacctcccagtctcagagagcactctgggagagtctcagagcttgtctgcacactggagactctttatctttgtctctatcttcccccgtaatgctcgagaggcagctccttgggccatggggccagtgaaagaggagaggacccaggagaaaacttctgtgacctcctcatttccagttcaacgggtgatgtgttgagcatgtgatctgaatgagggaacagaggctgggggaggtcgcatacgtaaagggtgaggggatagaaataacactgaccctggggtcaaacagacctgaattcaaaccccaaccattacacgtcaagctctctaacttctcagaatctgaagttgcatctgaaagcagatgccttgagatgcctcaaagggttatgctgcaaagatgaagtgagagcaagagtgtgaccaggctccgtaaatagggatgaaagtgaaagtgaagtcgctcagtcgtgtctgactctttgcgaccccatggactgtagcctaccaggcttctccgtccatgggattctccaggcaagaatactggagtgggttaccatttccttctccaggggatcttcccgacccagggatcgaacccaggtctcccgcattccaggcagatgctttaacctctgagccaccagggaagcccgtaaatagttatagtcagtaataatgatggctaccaccgatggagctcttcctcatttaatccttacacagccatgttactgtgattatacccattttacagatgagcaaactggagctcaaaaaaggaagaaagggcatatgtgatggggaagaaggggtctgacaccagaaccagagaccttagctactagccagccctcagagacataaaataaagcctagccagaggtggttatgggcgtgtgtgctaagttgattcagtcgtgtccgattctttgtgataccatgaactgtagcctgccaggctcctctgtccatgggattctccaggcaagaatactagagtgggttaccatgcccccctccaggggatctcctgacccagggaatcaaacctgcatctctatgtcacctgaattggcaggcaaattctttataccactagtgccatctgcaaaggtggctatggatgagaatattgtgggtgttcagaggtgagttagatctcatgtcttggatggagttgggaaggctggtccatggggtcacaaagaatcacacatgactgagcatgcacgcacgcacctgggggaggcaacctttttgatgggccttgagtttgggcaaaataaatcaagtaagaatggaaggaggaggaaaggcccaccttgcacagaagttgggaggcgagaaagtgtgcagtgtgttcaggaagtgacaagcctctgggaaaaggaaggaaagacaggtccaagtcaggtcccaagcaggccttatgccaggtgggcatttggactgaacaagatgcttcacgctgacaccaggccaggtcctggctccagaagcctggttttcataggaaggcaaattgacccaagtctcaatacccctcatgtctgttgtggcatcaggtactgtgccaaggcaaatgtgggtgagtggagcaagccaggctggccttgggcacctggagggactgtgtgacccagggcagtggaagggatgctcgtggtgcagctggcacatggtgtatagattcacacactttctactacatcccccccaacacacacatgcacacatcactcttttgcaggagtgtgtccacaccaagaggcccacacacaccctgcagcctgaggtgagggagggagagatagcagaggcctgctgaaagaaactcctgtgccaggcaatgggccaaagcgtccacgagctctgccacaaagcctccttgcggctatgaggtaggacttttcttcttaggagtctcggatggatgtgacctctgatactcaggaaaattaaacagtgctatacgcttggtcccaaggttggtgagcagcaaaatgaaagcacagactggctgcccctgccctgagctccgtagggcctgacacagtgctgggcactggggataagtggaggattggagtctgagtcacagggctttgaagctggcagccagagcagcggagcctcagagattccaggggtgggctggcccctgactcacccccacaccctgaggctgccccaggcagtggctttagctcctggccgccctcctgcctgccagagcccagcaaggcctcttctgagtctgtcatggctcaggattcccaggagctgggcgggcagggccaaagcctcaaggcaaggaggtatcctgggcacacctctgctcaggtatgtaggcctagagtcacagtgggaaccccggacctcaccagcctgatgtcagaggcaactaggcacttggggatagctgttaaatgaagaatgaaatactgtatttctgcatggcccagactccgggtggctcaccccttcccagagggaagacagccgcctggtgaggtgctgggtgcgccctggaaagtatgggttctaggcaacacggtgggtgtgactctgcaaaaccaccagctgcgtgtcttggctggtggtagtggagggaggagaaagctggggttccagcccctccaagtgcaggggcctcagagatgagaatccaggcattctggatctccaggatctctggtgggctgttccttctccctgtacctcagtttcctcatctaggtgtaggccaagggactttccctctctggctgcctgtcttttgcttttagaaattatgtccaagccttcatcgttagagcattttgaagatgtaatcaggcagaaaaggggacataagtcttcttcatcttaagcggtgtctctgcaagggcagttttgtctgatgagattaagtcatcttgtatattcactccagccttgggcctggaccatgtgcccaggcctgtgtgctaggccctggggttgggattgcaaagaagactgtgtctcagtgagttcataatttggggggagagacacctctcccccagaaataaccagatatttccaggacagtttaacatgcctttcaaagctctttgacctttccaatatctctaaccacatctgtcatgatggagaatagatgggtgagagattggttgtatagatatatggatggaaggatggataaaatgtcagataatggataaatggatggatcaatagaagggtggatggatggctgtggacatgggaggttgaatggatggatggagggagggatgaatgggtgagtaggtgaatagattgtgggggttgggggtgggaatcattgaatgtgtgatttaggttcctggtcccacagcagatgaatataaggggaaagttccagtcctgcctcttgttcattgtgtgaccctgaagaattcacttctttagctgtagagtgagaatctgtctggaaagacctcacctatcaagtgagagtcatgagcccagcctgcatcccaggtctgttgtgggtatccagtgaaagaggtatggactgcccatgcctacataatggctgtgatgagtcctcagtcagtggcctcacaggcaccggcaacgtgaggtgtttttgctgagggagtgacgcccctctgtggttgctggtgtgttcctaggcttcccacttcctccagcctgcacagagttctctgcccagttaggagcaaaggaggtgacctctgcagaagtgttgctgccagaggctccccatacgctgtacttgtcaaggagtaattgaggtgtcctgtttgttattcatctcagggtaagagtaggctcagcaagggggcacccagggcttgggattagggctttggagttacatagatctgccttccagccttggctctgccacttcctagctgcctgacattggacaaggcatgagcctcagtttccccatttataaaatagtaacaaattatagtacctaccccttaggtaggttatgacaattaataagcataacttatgtaaccacctaacatagagctcagaatatattaaatgcatgtgtatccaagtgcagaattgcgcccttagaactttgaagaaaagtccaaaacttcaagtctagagacctccatcttgaatgctcagtccttggattagtttccttatttcaaaatgttcagtgggactgacattcttcttgacaagtgtgccttgactgaacagtgtctggttttggctgcaattccaggagttccatgggcctcgctgaccctgtcctgattacccttaggttaatagcagactgggcacatgaattatccctttaaaagtggtttgtgtgggagctacaaatctttccaatgggctgagctgtagggaggaggagaatttagaagggggtgtcctcccggggaagccgcaaagaccaggagagctggtcccacaggaccgaggctactcttgcagagacccagtgtggggacgatgccgtgggcggtggcaggccctgctggctcagggtgagctgcagccgatggcaaggggcccagaccacccaccagaaagaggccctgagtctgagtggccctaggcttgagtgggggcagtcctgacctgtagccctgaggacataactcgggaacaggtcattatgggaatgtctaagctccctcagtcccgaaatccccaactcaggctggctccggggccataccctccccagacccccattccttgcagggtccagatatcccccttggccagccccatctgcccatctgctcgctctgctatatgcctgcatggtatgtgcctgcgactgagactctgtgtcccttccattgggactgcaatcaagagagcttcctgaaacctggtggggccaggtgacaacagggaagtggctggttttccagaaagtgaaagagcaaagggttccaggctgggagcaggagtgataacaatgaagtcacagagtctgcagagcttgcattttgggagctggaaactcagggcaggttgattctgcctgtcgtaggctatctgagctgagcaggcccctcacagtcgatgggaagagaggaaagctgtccagggaagccaaggaagggacaggacttgcccaaggccacacagcgtgaatagcaaagctggggacaaagctgcccactgctacaacatcgggtagctgctccagccctttcctgccctgttggacatcatcagaaggatgtttaatcctcgctcctgtacatcctccatcccatgccactggacagctattcgatgggaccaaatttatcattagtacaggggcaatcaaaggagctttggggtccccaggaaggtggcctaggcccatcccaatgtccctgccttcctgccagtgggatccttcctgacagcccttctcaaagggacccagtgcggctcagcttggacccctgggaactacactggtgtgcaggaaagggtgagtctggattagtagcccggagagtgtgtccagcccatcactgtcttgggcaagttgctcctcctcttggacctcagttatctcatctgcccaatgggagtgaaaaccagagagaatttctagaaggcagttcctagcatggtatatttcttcacccaaaaatacaccccaactatcctcttctgccagcccgccctccccacaaatctctgcttcttggattaggctggtgccaagtgtaagtgaagcaaattagtttgtgtgcaaatcaattcctccagcttctgacagggtgatctcctgtgaatccctgtgcctcagtctgcagcctttaccaacccaggcagggagcggggccaggtggggctgaggcagtgcagcagagcagctggtgggggcagtcagtaggaaccagagcaaaggagttgagggcccatgcagccaggtcagccaggaggcatagaggtgactgtcggggcccaggcctagagacctagggtggatattcttgttgttcttgttgtttcttagttgctaagtcatgtccaactcttttgtgaccccatggactgaagcccaccaggctcctccgtccatgggattctccaggtaagaatacaggagtgggttgccatttccttcttcaggagatcttcccaaaccagggatcgaacccacatctcctgcattggcaggcaggttctttaccactgagccatctgtgaagcccacgggccaggaactaaaggaaattcatgtgtgtattggaacagttggcttgtgcagacagaccatgatcatgtcaaaggcaagggaagagggaataaagaaaactgctgtttttaactcggcttgattttctctacctggaaaccaatcttgccagtgaggtggtgctgttcccggaacgctttcagccgctaagaccggggttcgctcaggttcccaggtccggcgtctccatttcacaggagccctgctcgcccggctggagcagcgggcagggaaggagggaaactggagttgggcgcagcctcccaagctgaccctgccaggccgggcggtggcccctgtcctgtcgtcatcctcctttcacagcagagagggatcctgtctcctggtctcgttaattcttctatcatgtttcccagactcggagcctctggttgcctattgtcctgagcaggcattttgcatttatgtaaagattagacaggttagaaccttcgctctcactccgatggtcttttttactttctcaaatccaagttctttccttctcactgcgctctgcttccttattctctctctctccctacctgtctttatcagcctccctgtttattttcttcccttccctgaccccctccttctccccactgacctgcttttcctctgtcctctcttcacagttcagtagtttgaatcctctttctcccccctccaccaccgccaccacaaccctaaccttgcttaattccatatttatcttctcccggagcctcatagaaatgactgaaagcattgctcacctcattccagaaataactcttctaaattcttagagaggcaccgcacgggggagggtgtgagcactggacagggagtcactgtggtttactggagagaacaagacccaggttcctctgtgggctcttgggtacaccagctgtgtgaccgtgacaccgctggcctctggccagtctctgtttcctcccaggcagcagtggagctggcacccagatgagaacagctgtgtgtaaggttgtgaaggagagaggacggtggtgccctgcacacacacttgtgctctgaaatgtttttcctgcttccaccgcagcctgagccagtcggagggaaggaaggggatgctaactggtatctccctccttggttctgctctgctctacagggatcacacatgcgcgcacacacgaacatgccctgggaagaaacaaagctgtttcttcaccgtcatctatttctcccttccaaaatgtctaatggtaaaatcccaactgaacacaggagcaaaaacttgggctttagtgggttcctgaatttctccatttcaaatccaggccttcattcattcaccgccccctccctcggacagcactcactcagagtctcctactgtgtgccagacgggctccagggctggccttctctggagctctggacctcgagattgttggggagataagcccaatgtcatgagtcaggcatgagagagagcacgggttctgggagttccaagaaatgagagggcctttcctcttgtgcctggagacagggtccctgagaaggagggactctgagccagccgaggggcaggagcaggatgctggcccccagggagcccctccatcactctgccttttttgcagaaagtcacagaggtgagccaagacatcctgtcctggccaagatgggaggttttcccaggggcttttggtgtacatatccacaagccacctttctggaaagggctctgagggccccttcttagcatcaaggaaatctgtgggtcacataggttaagaagaaggaaagaagggcacttcctgggggaggtggggaggaggcggctccaggctggtcagtggtcaggggtaaactgtgtccttccctaaggaaagcaggcccagagaaggctctgactctcccaagtccacacagccttgtaggtcatttacctcccacgcagcagaagggacaccctccacctggttgacagtaggcagacaggaaagcagggtctcctccaaggaaagggagggttttgcccatgggacctctccctcccaactctgagctctgggcaagacccatggagagtggggaggggctcacggcatttggaggatgacttgagggggtccagtgggactgaaaggggtccctggggacagcacgggagcctcaggactccaggaggtgctccaggctcagagggagcatcctcccccctttttcctccctcatcctgccctcctccctaccgcagaggctggggcgggccgggcgccctgggaggaggcggtgtccctggctccctgcccaccggtgcagggctggacgggcaggggcggagccatgcctggtgttataagaggcagccagggcaccgaggcaatgagctgtcgctcagcttggcagcaggacgctggcagcaggcacactccgcactccagcccagcctgagcgtgcctcaccactgtggtcgccatgcccaccgccttgtgctccatcgctctagccctgctcgtggccctgcacgaaggtgagcaccccccacgggctcagcagctgcagcagccccgaggctgcttgtctgtatctcctgctggggctctgtgccccccaagccagccgggggccttcaggggcaggagttaggtggcttgggggctgcaggaggctgtgctattagaggtgctgccgtcccaggacagccaccggtccttccaacccagagctgctggggcttccccaggctggcccagggctcctgagcactgagaatgccaacttcctcgattatgcaagaggaggagcccagcgggtcccccatcccagctgtgccaggcgccctgacccacctctccacttttctctccctcctgtgcatgcaggcaagagccaggctgctaccacccccatcccagagcaaccagcgcccttgccccgggcccgaggctcccacctgcggactcgacgttgctcctgcagctcctggctcgacaaggagtgcgtctacttttgccacctggacattatctgggtgaacactcccgggtgagctactggagggatccaagaggggttgcagggggcaggggtggggaatgctggcatgctggggaagccctggcacactgcagctctctcttggagtgtggggctaacaacaatagcaatcagctattgcttcagttctcacgtgggggctgcctgagcaagacagagggctgtctcatgaaaatcctcacaaaaagcctggtcagaaagtgttggctccattttccagatcagggtactgaggctcagagaagttaggtgccttttccaaggtcacacaggaagagtaagtggtaggtaggaggctccagcctaggtctgcagatgccagagcgcacagcggctctgccatgctgcctctgtataatcttccaagaatgatatgattaatgacagcacccatgtcttgactgcgccaggccctatgccaagcactgctggtgcgttatcacctcgtgaacgcacccccatcctccccagtgaagcggggactgctgctgtccccaaatgacagacaagagacctgccccatgtcacctggcagagccggggtggggtcccagagctgtctgttctgtctgcacccgcgctgcctccgggccactgcatacttcaagttgaagtttctctgtgtgtttgtattttttttttccttctccaaattgcaaaagacaagagaagcccggcacgtaagcgtgtgtggagctaatccgcatccaaacactggctcagggcgggaaccctgccagtccctgcgtgctgggtctacctggagtctctgcagctccaaccacaccgtctaaaattagctcaggcatccgaggtgctggtctgaccggccacggggccctgcccttcgcctggcccgtctcagccagacggaatctgaaatcgatctcagccaatctaatatatctatgcacacacacgcacacgtgcaggtcaggcacacgcaccattttaaagtcaaaactctaagaaacacttgggtcacccttccaggcaagtggtgaccggatggaggcagctgagctgtgagcctgagtgttcacttctgtgagagggcactctctccctttcttccagactagttgggggtcttctttgagaacagggggaccagcctgactccatcagttcaaattgctgtctgggagtgagaggggcagggaggacagcttccacccctcccccccatgctgagcgtcttactgagcaggaccagggcagttgggagggaacagaggcccgagagggtaagggtcttgcccgaggctccctggcatgtaaggaggaagctgcagtgggaattcttgagggcaggagctggttacttttgctgccaccctggtggcatggatggctatcccagtgtgcagtgtggacagtcccagcttgccaatggtcctggtttatctaatcctctctctgtctctctccaccctacaccactaccttgctggcggcccgcccacagacagacagctccttacggcctgggaaacccgccaagacgccggcgccgctctctgccaagacgctgtgagtgctacagtgccagggaccccgcctgtgccaccttctgccatcaaaggccctggtaagtgggcacccagcctgcaaggggccagaggtgactgctggcctggacctgctctggagggcagggtgtctggaaggccagcagtggcggactgttagtccctaggtcgtgcccgactgtttgtgaccccacggactgtagcctgccaggctcctctgtctatgggattctccaggcaagaataccggagtgaattgccattcccttctccagggtgtccaggaggccagcagaggcgtggctaaatggtggaggaggggccaggggagcagggtcctgggggtccagaggctgccctgggctgtggggcagcctcccttcctgcagggagccagtcacccttgagtcttcccccctgccactacccccagctctgggggcttctgagaccattgcgtccccactcctgggcaggaggaatcctccccaggtgatagctgaggcagcacaggtccagagaggaaacaggacttgtcctgtcaggctacacagccagttagacgagagctgggccttccgccttagtcgctggggctctgggacctctggaactttctcagtggagaagcagtagctggagttggggggccatggcaccgtccccgagctgccacaaagcgcctttgccagtcttttggccctctggacctccctccctccacgcggagcgttgggaaagcagacagtgacttcaccctcccctacctcccgctctcatgaaggcctatgggaaactcctcccctgagacctcagctgtggctgcagccctgcctcagtttccctgctgagggttctgcttggctgcaagtggccagactctgggaaggccagccaccccactgcctctttctgaggctgagaacgcattcccagtggctcagttttcctcaggccccaccccacctgggaaaagaagggtgccaggtgcacagggtggaaatggatctgctcctgagggcgggtcggggcggggggctgggctgggcctgcagccaggcagcctgggggccctggacagcccctcacttgggccctaatgctgttcactcaggactgatgcggtggcagtcccaggcagcgggtcccctgcagctgcgttccaggatggcaagacacaggccacagcaggagagctcctccagcggctgaggtgaggggcccctacactgattgagtgccttctgtatgccttgcacatttcccttattctccatatgacgccttgggtccttatggggcagccaatagcagctcagacagatgaaggtgtttacccaaggtcacagagcaagctacagcatctggctgactcaatagcctgtgttcttaaccactatgctctttgttaccgccaggcctggaagtggacttttattgagggtttcaaggcttgtgactgtggaaggttcccaggtgttcattcaggctgtgtctgaatcaagcatctcccacatgctggggtccaaacggatgctacccagcctgttccctccctgggtcccagactggactgtctccctggtagctacaacatggctcagctcaaggcttggcatccaggaggtgcccatgaacgtgtgtccaaccaaactgacttgagaacagaaacctatagccagtcatgtggcagggtggctgaaggggcagcatctgagctagaaagtcccagccctgccacgagcaagctttgtgaccttggtctgctcactgaacttctctgtgcttctggttcctgtctgtgaggcagggacaccgctgctatccatctcacgggcttgttgaagtttagagcagttgacatacatgaagagccccaagaaagcccaggccctacgggagctctgaaggttttagccatcccgaacctctgtccctgagggttcctcagggctgcccagggccggggtgcagcctagcccctcaagggtccacatctctgtgaggaggcggaaacataggcaaaaagacaggatggccggctaggcaggacccaggatatactgaggaactatcttaaaaaaataataataaaatgaaagtgttagtcactcagtcgtgtctgactctttgcaaccccatggactatagctcaccagactcctctgtccatggaattctccaggcaagaatactggagtgggtagccattcctttctccagaaaatcttcccaacccagggatcaaacctgggtgccccgcattgcaggcagattctttatcatctgagccactagggaaacccaggaaatgtcttaagatgaaaaacttcaaggtaagactttgcaagtacttggcattccataattagcaaagagtgttttcgccagtctgtactcagcctcacaccagttcaggcctgtgtttattttacagaccaagaagggggttcagagaggttgagacccttgcccaagttcccaaagctgggaaccagcctcccagttcccaggctagaacgccttaagccagagtgaggccacctagatgacggcagagcccctaccagggtctcagccagattcaaaggactgctaggatccatacatatctggagctggaccttgaagaatgggaattttagggcacggagtatggggtgagtggaaggtcaacagcctgaagagccacagggatagaggtgtggaagtgagagggcaatcaggggagagccacggggctactcttggccgtgcagtcaccctggtggcacttgatgttgagcatcaattttgtcaaagctccttgtgggcagaaaagcttctaacctgccccggcctctccttgaggttcagaccttgttttcagggttggctgtgaccaccctctgacctcttggccatgaataaggaatccagaccctatgaccgctgcctctcatggggaactctcaagtgatgtatatctccagagatgctcaattgacctctttccatttcagggttatttctgcaaccaagatccactttgctaggcaacagcagaagccgacgagggagaccagacctacacactccaggcagaggaagagatagctctcgactctgggagaactttgggaaggaagcctgtgtggatacaggaggagaggggcatcccagagctgggagaccttccgacctgtttcctgggccagaaaacccagctgctggagcaggcacaagctctggcctcctcgccctggggagggggcctcgctcaaggcagctccgtgacaccaggaaagtcatcaggccccaggctgcagcgtggcctcccacactggctccagttcctaggccctgctgaaaggaacggcatgcggaatgtgctagcctggaggtgtcctgtctggcggctgtgaaccaggaacaacgtgcagtggcgggcactcacacccaagccagcccgagtccttccagggttgaagtcccggccgcccccgacccctcacccccgctctgtcccctccagccctcgctctccagtgtccttattctcccttcataccctcggggcactcttggtgagaagggcctgcaccacttcacctgtctgtatataacttatttgctctaagaaatttgacgattccgattatttattttaacgtatttttttagactctcaattatttacctgcgaacttgtgtttgtaataaacaacaaaataatgctctagcatttggtcttggttgagcaggaggtgggaggcacttttcaggaaggggctacttagaagtgaagggaacaaagggacggcggggaaagagcctgaggcaggtgtggagcactgagttccacacccctgtgccccggctgggcatcgctggctgctgacccaccctctctggacttttgcctatcatgtgcctagacagccatttgcagctttgatatcccgggttccaggacctgtgtttctatcaggccggtaagtgttggccaggcctttccccagagcatgtttcataggagccaagactataaggacccacttctgctctggttgccacccctgaggttcagagcaaacctgtccagtgagggctgtgtgctgttccaagactgtgtgcagccttactggccagggatggctgttgtaacggagtcacaggctggtccttatccctcaccctgggcttggacagaccccgctgggggcgctcaacacttctctcactaaagaagcccagggctctagcactggcttggctgatcctgccaaggccccaggaagctgctcacctgagtcccagggacagccagaagctacccccgctggcagctcctgagacctacagcctccactgctgccaaatccccctgcgaacaaactgttccctttcccctggccggcctctgctgggaatggtacgctgtggcctgagccagttattgaaaaataattatttacacactactctaagcctgccttgtccatggagccagccccaactccctcctgggagaagaacatgttgacgcatattgaactcctactgtttgctggcattttatgcagataaactcacttcatcctcatgacaatcccatgatatagatacttttattatccccattttacagatgaggaaactaatgcacagagaaggcaactaattttcctggggtctcgcagcaagtaagtggtagcatcaggatttgaacccagagtgtatagtacacatgtctatatgtactgactaaatatttgttgattgaattcatggattaccactgtagtatgacattgaacaaatcttcctctttctgagcctcagttttttaatctataaaatgggaaacagtactttccactttgtagagctggttgtgaaccctaaatggatgagttatggtgctgggctcagtcctgggcctgatgagaggcaaagccgaatgtcaggccgttagaagtgatgatgtaacaagagggacaggcacaaagctgcaggacctaagttggggggagattggggctggctggtgtgcagaggcatggtcagagaaagatgcacgactaaggtgccactcccacagcctaaggagagtgagactcacatcaatagaaggaaagtgaagagggagccccagacagagcagacaggaagggtaaaaggttttggcaatgggagtgacaaaggggtttcccatggaggaccccatgtggctggagcatggtggggagagagcagcaggagaggaaaccaggactccctggaggccaaagtagggagcctgcactttctctcatgggccatggggaccctcgaaaggtctgtgggcagcagggacctggtaaagccagactttgaaaaaatgccagagggccacacagggggaccctgaatggggagacagaaggcagggaagcaagtcaaccgctggtccttagggatccagcctgggtggctggggttggcgatggagccacacagtcacttcctacccaggattccggcacacctctgaaatctcactgagcctaacgccaggtgaatctcactccccagcatcctgttcaaaataaccctgcccccacggaaatcccaaagcaacggccaacagtcaggctaggcagtgatgtggggcaaccccagcatggcaggagtgatcgagaccaggtagaggaatgtaggttgaaggtgtgtccgaggcccagggaattaggcattcactgccctggtcagagttcagagatcagcgaccaaatgattaagtaagagacaattagagggaggcccagaaggcaggtgaaggcaaggcgataccataacccccaggatccttactctcaagaaatgggggcccctggcttgggccctgcactctagccctctgccagccatatctttctctccaaataagaagtttgcagggtgaagggtcatgaatacccaaagtctgagcctgcttctaaaccacattccatgcagcaggggcctcagaagtgtgggggaaggtgggatagagtttggaagaagcagaggaaaatttatgaagaactgttgccaaatcaaactgaaccctgggaagaaaggtgtcaacattttagaaagcatatctggattttatgggacaaaatcgtccctttttcctgcctttttctgccttttccataaatacttacaggtttggtttaggctttctgagttaaacttgtgttccttttaactggaacaccaggcggagataggccagaagggggcacagggtgacccagatttattcgggtcatgtgcatgcatggaagcagagtcagaggggagtggagttccatgtccaggactgtgcagcctgatacatatccaggctacagactggccctttcctgtcctggactgcctctccctccactctctcattcagcaaagaaccccaaggaactagtttcactcttgccatctcactctctctctgaacctcagggatttcaattgagaaaagtcatttgcctatcagggcaatgaatcattggagtgtggccatccatgcgttcaacaattatgaacaatcaccgttcagagactcccgtaaacaaggcagacacagcccctgccctcacaggccaagaggagagcctttcaataaagcactgttactatgaaggtagaagtgaaagcatttattgagtgctcatcaagctcttcttgcacatggattctttggatccttgcagcaaccttacacagcaggttctatcatcgctattcccagttgagagaagagataacggaggttaagcagctcacccaaagtctcatggctagcatgtggctgagctgggatttaaatctcaggctctcagcctgtctgctgtcctgctgctctaagcaggtagatccatacatagtgtgattgagcccctcgggtgggagagtctgggaggcttcctggaggaagtgacagttgatcaagagaaggagcgggtggacagagtgttcaggcagggggaacagtgtgtaggaagggagctatattctctgtgcttagtcattcaatcctatttgggacctcttggtctatagtccgttaggctcctctgtccatgggattctccaggcaagaatactggagtgggtagccatgccctcctccaggggatcttcccaacccagcgattgaacccaggtctcctgcattgcaggtggattctttaccagctgagctacccaggaagcccattctcagaccctatcagggaacaaaagaaggaggcatggggaagactggagaggggttgctagcggggtcgggggggtggtgggcatgcggctacaagcagggaaatccacagctgctgtcacctcacccccaatctgtgacagcctcagacaatgtccccctggacaatattgccatgcctgaaacacacctttggatcaaaccgtgcttgcgccccttggggtttccctaggctggcaaggaagacagacaaggcaaagtgaagagacaggaggtggataggttacgggctgcccttccagctgtgtgcccttcctgtctccctgggatctctgctcatttcatcccaggggcgttgtgggttcacagggaaagcttggggaaggagtagggtttgcacacactgggatgagggaaacagccggagcatagaagaatccgaaaagaggcagcaagcctgattggcaagggccaggctgggaacagcatgcagtgccaggaatttgaacttgagtgacggggagccagcgaaggtggctgatcaggggagagagccaggacaggagctggccttgggcagctggcttgtcctcggctcttcctgcctccccggccagtgcttccagctcaagggggccctcccagcccctcgcaggagagacaaagtgtgggccttgcctccgcctgccagggaccggagccaagagccctcagcagctcggaagggggccatgtgcgggcccgccaggagccctggaagaggaatgtggcctaattaattctccaaagctcagagggcctcgccttgtgggagcagctgccaggacaggcctgccaggacgccacaggcccagcccgtctatcattcagtgctcggggacagcaggctggaagcctggagacaggggcccagggggccagccccttgcctccaggtacacacgtgtcctccagccccttaacagaaaatagtgcgataatagtaataatcgccaacaggccttgagggcttaaaggtgtgtcagactctgtgcaaagcctgttatactcacttctcatctattcattacgaaggaccagtgacagggaaactgttaccatctccattttgcagatgaggaaactgagggacagatgggtgaatttccctggccgaaatcctgcaatcaaaaagcacacgcagggaagctaggattgggatgtaggcagcctgggccccacaagcatgttgtcataagcactgctgagccagcccagcgaggacatggaggcccagggtggagcgatacctttcccggggacagtcgactaaaaacaggccctgggacattgaatagggaagaaagaccacacccctgtcctctgcttgaactgcctcctcctgaagtttctcatagggcttttcctgtctcagcccgtaggtcatcctcaaagacatgtgactcgctactccaggcagatgggctggaagaagacatgccgtctccctgggatccctgctcatttcatcccggtggcgctgtggtggctgcactggcagctgggcgaggtggtctcacagcttcctcctagcccgctttccatccgtccacggaacacatcccctccaaggcgggctctgaatggtgcagggacggctgtaccagggccttccaactagaaagtggcagacccaggagaagatgggcacacagactggcccgaagccaagactctgctcttcctcagcagcagagcaggaggagggcagtgcagccacatcgcatcccctctctgggcctcagtttctcatctgctgtatgggcctaagagcattaactgtatagtcttgtcctgcattcatgcaggctaagttgcttcagtcatgtccgactctgtgcgatcctgtggactgtagctccccaggctcctcaatccatgggattctccaggcaagaatactggagtgggttgccatttccttctccagggggtcttcccagcccggggatggaacacatgtttcttacatcttctgcgttggaaggcaggttctctaccactagggccacctgagaagccccatagtcatgtcctggaactcattcatgtgtcaagtactgtccgaagtagtttacttaatttttaaaaattttccaaagcaaggttttttcatagctttgtaacatatcaccataaggctgcaccatatgcatctgttactctgtaggtgtgtattttagtttgtcccatttccctccaatgcaatgtttacatgtgtgctacatttatacacaaattttatattcattcctaattcttttttgctgcatattttttatggagacataatttacaccccataaaatccactcttttaaagtgtacaattcagggtttttttttaaatatattcacagttatacaaccatcaccactatctaattccagaacgtttccatcatcccaaaaagaaacacctcacctgttagcagttgctccccagatctcacttccccggcctctgtacaccacaaatctactttctgtcactatggatttgcctgttctggacattttatatcaatggaatcataacgtacgtggccttttgtgtactgctccgttcacttagcacaatgtcctcaagatttgtctatgttggagcaggtgtcgatacttcacgcttttccatgactgaataatattcccttatagagacagatcaggcttcccgggtggctcagtggttgagaatccccctgacaatgcaggagatgcaggagatgtgggtttgatccctgggtcgggaaaaacccctggagaaggaaatggcaacccactccagtattcttgtctgggaaatctcatgaacagaggagcctggcaggctacagtccatggggttacaaagagttgaacatgacttacaactgaacacacacacacacacagatcacattttgtttatccatttgtctgcgttgtttccactcttttggcttaagcactttactttagccttcagtgaccctatggggaggtgctctcttttcatcatataaacaacaagactgacatccagagagcttaagtaacccatgcaggtcacttagctagtgagcggcggtggtgggctttgccccaagagtctggctgcagagacagtggcctcaaccactgagcatcactttctcttcagtcagagtaagatagtataaatcagcacccacagcaactgtgccaaaagtggtacccacagggcacttaacagagggtggcttttctcagcagcatttctgacactggcagagccagggtctgccaggcagggcctgaagctggagcaagagtgtctggacagccagtgataatagtgactatctcagtacacgggtggttcttccagcaatggggacatctctccacacttggtggggggccgtgggcactgactcctctgctgcacatctctggcctgcaccccagagcccatctctcctcccacctccacctacaaagtcatggctcccctcctgtccccaaggccctgacactgagtaaccgaggcagcattcttgggtgaggtcaaggtcagagctgcagtggaggctgcatggacccttgaatgggtctctgtctcctcaggcctccacctactaaataattagataagaaatcttaatacttccttttttaattacaaagcaatttaaataggacaatatagacacaaaggcttgtggctttaagataatgaaaagactataggaacatctaaaataaaatgtctcttctgggcctcccactccaaggcaacgactctgagagtggggtaaatagccttttttttttctatgggttcagatatatgttttctatctaacgttttagaggtattaaaaataatgcacggcaacataagtttctctactttacaaccttttcttctcacaccaaaggcatctttccagaccaatacaaggcttttaccacctcttaattttaacagctccacgtggcccttgttaaggacaggcagttgtcacttgactgtccacccactgaagccttttggatggcttgcatttcttgttttcataagcacactacagtaagcacctggtttatacatctttgtctgcagaggacagatttttagacacgaaatttctaggtcaaaggatgagcacattttaagtattctgccgagaatgagattccaatttgcattcttgttcccactgggtatgagtgcccttttcctcacaagccttccagcactgggttttatccatctcttatcgtttgctgccctggtagcaaaaccacttcttcataaggaatacgatgtgcaaaagagctttgcttgatgccacccagggtgaggagggtgaggggtctggagatgctccaatgtctcactctgtcccctggtgcaaagaactcctctagggacttccagcactgctctccaggattctgtttggctctagggctctgtctctcagttccactcaggggttggccctcagggagctaagaatggaggaggggctggccagtcttcctgctcagttggccccagcctcccctaatagatgtgtctttgagtaggcgctcctggggacagcatcatcatgggaaagcgtgtgtgcgtgttgggagcggggggactctgggcacctgaacctgcagatgttcctaatgggggagcctggggcatcctggttccctctcagcctgccatccaaactcacgttttggaaaagactgaatctggatcttgcctctgcccaggtcttgctgtgtagacccaggcaggtcactgtcctttctggactccaggctcccggctgccaggctgggggaatccctttacagggtagatgccgaatctgctccctctggagactccacactggccacaccatgcgcatgagtcacccccaagttggcaggctgagggcaggggaggggcatggaggcaagagaagggaggctcgctccagatgactttggtgccacatggtgagtctggcgcagtggagtcttgcctggctaacgtgagtgtgtgagcacaggcacacagggcacaccgacgtgtgaagtgcattcttgtataccgaccggggatcctcctgctcaagtctgggcattcaggtttacagctcaggtgatgagtgtccatacacaatccatgtgtgtgcacattcttgtgcgtgtcaacacatacacgcatgtgtgcctgagtgcccctgagcttgtaaatcttcacctggttgtggctgcctagatgtgtctgcatgaacgtgtgaaagtgttagttgctcagtcatgtctgactctcctctgtccatgggatttcccaggcaagaatattggagtgggctctctggggcattttcccgacccagggatcgaacccttgtctcctgcattgtaggtggattctttactatctgagccaccagggaagcccagatgtgtgtgcacacatgtgcctaaatccgtgtgcatgcgtgagggtgcaggtgagcctgcaggatgtgcgcacacgtctatgattagagattacgggtgtgtgggtgcacaagtgtcacaaacatacacactaatgtgtgcgtttgtgtctgagcacatgtcaaaacacatgcatagagtatccgtagtgtagatggagtgcgtccacatgtatgggtctagaagggcttcagtgtgcatatgggcacagctatgtatgaactattacagtgtaactctgttgaagtgaatacacatgagtgtacatttgcacccaggaggggccacctcagcgtctgcaaactatgacatctcctccagggcccatcccacctggcctggacctctcccctcaacccacactgaggaaccaacagaaggacagtgtcattgctttaattacaggaagactaagtattttagtaattagtaagtcattataaagcttactgcttttaagaacaaaaatggctatattatagatacaaaatgcatatggaatctgaacaagaagcatggaagtgcaggattttccaccccaatctgggtgggagggcttgaagaccaagtatacacagggctcaggaaggcaagggagggagaggccagagcagagagcccctgcctccatttccaaggctgtccacacctgacctccatccctacctccatccagcgagatatcgttctgggcccagagggccccaaccctggcctgagtggaagtcagggagtgagtgtgtcagaccacctctgacagcaaccagtcaaggcaaggcccttctcattctcccttccgtggcctataactctaagatagtcatacctacctgggttttctcaaagaacctcaaaatataacctccaacacgtgcctacctccttcatcctcccagaacaatttctacctcccacccccagctcctgtccttctctcttggcctgcactgcctccttgccacaggtctgacccacaaacttctactcattggtccaaaaccacgcctgtgtcaccacccagctgtacaattgtcatcccagctggactgtgaactcctgaggtagggaaggctcaggcattcttgggtccccagagcccacctcaacctggcacagcttagatatcactcactatctgattttagaaactgagataagaggagaagaaagggagagcccctgggcgcagcaacgtttggtaaacacggcaggtcgttgggtgccccaagactggatgagtcagcctgacccttgccctggaggaggaagaaaaagtgtcatttatcaggctccacctggtgccagcatcagccacacacttgatccccaccacacacctgagaagtaagcaatatttttactcccattttatagatgcagaaactgaccctcacagaaagtgagtcagcagcagagctgggactcaagccttcctgactcagcacttcctacaggctcatccccccaggttctttctctctgnnnnnnnnnnnnnnnnnnnnnnnnnnnnnnnnnnnnnnnnnnnnnnnnnntcctcaggaacagcccttaatcataaaggattggggtggtgggtagatacgccagctcacttgcaccatgggtggagcaactctaaggctgcttccacaccctctcccggaggtctctggaggggctaagccctgtttccacctgttgctcattaacttgtctgtattggctgcgcttcctttctcccttccacatcttttatggatcttagaaccacctcgaaaataaactccatgccctcgaatcttagtccaggtcctctctggggaccccaacccaagaccaaggggcagcagccacagggactgtgagtctgggaaagccagggggacattcttgcaaagaggcctcggccacagaggcccagagacacatgcaggtccagacccatgggatgagccctggcaggcgggaggccagcctgactgcagctccagagctgcacacagtgtcaggctggcgcatgaggacgcaggagcaccagggtaaagagggcacgggtgtgagcacagcagctgatggcaacggggtttatctcagggcccaagaccacacccacacctccctcccttctgcagaaatgggcctggaacacctgtgccctggcaagccctagggtagaccccggctggaaaaccccagggctcccagctggccttctactgctcagcacctctggcctgggtcctggcagagcagggaggctgcctggggaaggtcttagatggcaaatctgtacaattctgtgcctctctgtccttcccattcaagaaatggcacagggccttggtagggccgaggaagtgaatggagggatcccagcacctcagagggcccctgttctctgactctgccaggacatagtttgcacacagaacattagatgtggcatatcttgcttccccacgcttttcagaagagggtgggcttccctgatggcactagtgttaaagaacctgactgccagtgcaggagatgtaagagatgtgggttcaatccttggatcaggaagatcccctggaggaggacatggcattccggtactcttgcctggagaatcccatgaacagaggagcctggtgggctacaggccatggcatcgcgaagagtcagacacgactgaagtgacttagtatgcacgcacattacttaacccagaggaatcaagttctaacggtggaaattcaagcattggaaaagacatggcttgattttaggagttggccttccctcaaatcacaccatgtcaaatctcagacaggcagcatcatgaagcagaaaaggcacaggctgtagagccagacagacctggctcaaatccttggagacagaaaagcccctcatcctgagctttggcttccttggctgtgaaataagttgacagtgtccactggcgggagacctggcttcagtccctgggttgggaagatcccctggagaaggaaaaggctagccactccagtattctggcctggagaatcccatggactgtatagtccatgaggttgcaaagagttggcactactgagcgactttcgctttcactttcactggccccaggtaagcatcttcaatctccttcagtcctcagtctggtgaggaagtaactccagagatgagcagatgggcactaaggcggccaactcctgctcaggtgggtccagagtgattcagaagcctgctgccccctgccaggggcctctgaggctgggctgtgccctgtccacttcaccctccccctgtgtggcccagccctgacccgagactcacccactgcccggtttcggcacctggcccacagttagccagggctgggtcttcagtatcaacattcctctgggataaatacctttggcctcaggaatgctgggaactgggccaagaggtcaaagggcctggactttatcctgagaagctcttaaagcctcacagcacctagacgaggcaggcgtagcccagtcataaagagaaactgagagccactgatttcatccaagaaaagaaaccaggggcctccttggttatcctccataagaatcaggacagcagaagatgaaaaaaatggactcaaagcaagcaacagactggaaattccacttctgggtatttaccccaaaggagtgcctagatatgttcatctgaagatacatacaaggttgttcacagcagcattgtttataatagtctcatactaagtgaagtaagccacaaacagaaagacaaatatatgattttccttatatggggtataagtgataccccatatatcgcttatacaaatgataaaaatgaacttatttgatgaaaaaaatgatacaaatgaacttctttgcaaaaccgaaacagactcacagagaacaaactatggtcactggagggaggagttggacatcagcatgtacacactgccgtgtttaaaataaataaccaacagggacctggtgtatagcacaaagaattctgctcaatacagtaataacctaaatgagaaaagaatttgagaaagaatagatgtatatatatgggcaactaaatcactttgctttacatttcaaactaacacaacattgttaaataactataggtaggtaggtagatttagttgctaagtggtgaccgaatcttgcctgccaggttcctctgtccatgggattctccaggcaagaatactggagtgggttgccatttccttctccagggatcttcccgacccaagaattgaacctgagtctcctgcactgcagtcagattctttatcaactgtgctatgagggaagaaaactccttaatgtaattaactatagttaacataattagtgagtgaagtgaaaattgctcagtcacgtctgactctttgcaactccgtggactatacagtccatgaaattctccaggcaagaatactggagtgggtagcctttcctttctccaagggatcttcccttaactagaagttaattaactaattagaagtaaatataattaactatactccaatataaaatttaaatatatactagaatgttcatagcagcactgtttataatagtctcaaactggaaactatgcaaaagggcagcaacagtagaatgaataagtaaattgatccctggtggctcagatggtaaagaatctgcctgcaatgcaggagacctggattcaatccttgggtcaggaagatcccctggagaggggaagggcaacaaactccagtatttttgcatggagaattccacagacagaggagcctggtggggtccttggggtcaaaaagagttggatacaactgagcaactaacactttctttcttcagattgaactacaactgataaaatcatacggatgatcttacaaatgaaacaagattccatcctttaagattccgtatgtctatatctatatccatgtatatctatatatctccagttttagtggtgccagaactcagcaaagtgatttcccttgggggaatgagggcaggcagtgactgaaagggaactggaagggagcctttggagaagcagtcatgttccattttttgatatagcttcagggtgcatgggtgttcttgttttgggaaaatccttcaagttgtacatttatgatctgtacacttttctatatgaatactatgctcttgaatcttgtgttggaatcttagcgatatgccctcttctacgtatggcctcttttgtgcaacattgtatttttgacattcatccatgttgtgacatgtaacaagatttcttctttttcactgccatgtagtattctattacccgaatagaccacaatgtgttcatccattctactgttgatggaaggtgggttgtttatggtctaggagctattacaaattagtgctgctttgaccattttttgtacctgagttttgatgaataaatgtacatatttctgctaggggtatacctaggggcgggatggctagctcatagaatatatacatcttcagctaacggcaccccactccagtactcttgcctggaaaatcccatggatggaggagcctggtaggctgcattccatggggttgctaagagtcggacacgactgagcaacttcactttcacttttcactttcatgcattggaggaagaaatggcaacctactccagtgttcttgcctggagaatcccagggacagtggggcctggtgggctgcagtctatggggtcgcacagagtcggacacgactgaagcgacttagcagcagcagtaatgctttggaaggaatggtgctaaagctgaaactccagtattttgggcacttcatgagaagagttgactcattggaaaagactctgatgctgggagagattgggggcaggaggagaaggggacgactgaggatgagatggctggatggcatcaccgactcgatggacgtgagtttgagtgaactcagggagttggtgatggacagggaggcctggtgtgctgcgattcatggggtctcaaagagtcggacacaactgagtgactgaactgaattgaactgaactgaatgattttccaaaatgttttaccattttggacttccatcagctgtgtatggcagcctcatattctcactagcacaagcacaagcatgctttgtcttgtagccattcaggcaggtgtgggataatttgcatttccctgctgcctagtgaagttgagcacctgtcttagtttgggttccctaggtggcgaccctgagacaaggatttgagagcaagaagtttcttggcaggtgtgttcgtctcctaaggctgctataacaaaataccatagactggtgtcaaaacaacagacctttattttctcacagttctgaggctagaagaccaaggtcaaggtgccatccacgttcgtttctggagaggcctctcttcctgccttgcagatggttaccttctcaccgagtcctcacatggttgcttctctgtgcatgtatagagaggcggagcaatatttctggtgtgtctttctcttgccttcaatgtaaggacaccattagggcctcaggcttatgacttggtttaaaccttaattatctccctaaagacctgatcaccaaatacagtcacttgggaaggtagggagacgtgattcagtccatcatagcaggcgatcctaggaaaactcacaagggagtgaagaagtgacagcatgcgggaggaggctctggaagtgcgtgtccacaagccagttgccaccctgggcatctggagttgaatcccacggggagattctgagaaaccacgtaaaccacgccctcgagagttatcccactcagggcgccggggaggtggacttctatacatcgactcctgccggtcactggttgaggcctatttcaaagtatgggggtgtggggtgggggcggtgatgttagctccctggtgcctcccaggctcacagaagccctgaggctcggagctgcgggtacacaggccacagcacgtcctcacatgctagtaacggtcgaatcctcacttgagtgaagtggttactcttttgaagctgagttttgaaggatgtatacagatgggccaggcaggagacagcattccagcagagggaacggtgnnnnnnnnnnnnnnnnnnnnnnnnnnnnnnnnnnnnnnnnnnnnnnnnnnggtcttccagggccccccagtcctctgactctcccaaatcctgactatgtactgcaagcaccactgaatgccagaatgtctcccatagccagagacatagacgaagttcccagcagagaggctgcaagccaggtcggggccggagcaaggacaaagggaccagcgttcccagggcaacagaggctcaggccacaggatgggcatcagagaagtcaaggcagatctcaaggttgacattaacaaaggaccttgagctaaggtatggggtcctgaagccctgagaaaggcccacttatactcacccccatgccacctgagttcagactgtgctgatcctcctcagtgtcctcccaggtccgaaaagctgtgcatgtttacactgtctgcagagcctaaaccaggaaggcagagggtcagggagaggcgggcccagggctgtgggcttggatgagaaccccctaaccaccattttgacctgaggggaactgggaagtgggaacctaagacaggtctgagcaggctctgactgctctgcagagctatcagcttggagtccagccacatccagttctgtatccaaataacaggcatctcatctgcagaagtataacctggcagggcccaggcatcgtgagtatctgtcagtccagccacactttggcaagtcatgtcccccctactaatcctgctctgtgtggcttgggtggggcagtctccccacacccaggcggcgggcttgtgaaccatgcctggccaaccatgtccccacccccaggtgccgtgattgactcaaggataaacccaggaccctacccaggccaacaggagtctcccttgagacttttactagcgatgtctggaaactctctcatctgctgagatcctgagctgtaaagaagagatgggaacagctggtggacagcttgcaagatagagaaaatctgcccagaataaaagaaagaaagaaaaaaaaaaaaaaaaaaaggcaggcctagctggaagatggagagagagagaaagagtctttgtggtgtcaattaaacacctgggtgcagcatgtctgaagttcctggactcctcatttgcatgagccaacacatttcctgctgcgtttatgtttcatcatggtttctgatgcttgcagtctgaaaggatctgatgaaaatactgggtgagaacacaaccagtgttcctttctgcaccttcatatctcagagatgtgcacggagtttctttaaaaagggcctttgcgattggaatgttgcagtgaggccaagatccctgtcatgctgcccttctttgccaaatgacaactaactgactcaaagtggagtaaacactgccaacagcttacattcaagagttcaggatgctactcccactggaagacctgtcctggaaagctgccctctgcctgactccccagagtattctggaaggtgcatttttctgaccaacagtcaggattaattactttttcatttgttgaaatatgggggtcagagttatatagacttaagagagagggaagaaaatagtgcatttttgcaactccagcctgaatgggcaatattgcacgttgcacgacttgatttgtttaattcaatgaagctcgacaatccacccaaatgtgtttaaccataggggtttggttaaataaattataatatatggattaaaaaagaagtaaggtagctctgaaatataccatcataaaaatatgtctcatgtatgaagtgttaagtgcactttgcacaatcacacctcaataaagtgaagttttttcaaaaatcaatttgcccaattatatgtataacatatgcccattaaaaaataatacaacagtcctataacttgcaaaagtttgtcatttatatgattaggtgggggaggtgggcaggaaaggaaggcgaaaacaatttgcaattaaagtaactcactctccttggatgattcagtccatgccagctttagttccctatcagagctatttccccttcacaagctatttcccaagacggaaagaagtataagcttgggaggctatgaactagaaacttgggcgtctaagaactagaagctgggatgtctttaggacttcagggaagagttcctccctggcctcacatctctcttgtaagaatgcctcatcctatgggttcagagtctcagttttcatcccagctgccattacctgtgcagcaggcagagcccagggctgattttaaccttgcaaagactgtagacgctccagaagaggagtgctgatcaggatccctgcagtctggctaggacttggggacattgtgaccctgtccagggtcctgactggcaagtgacacaccagaactcagtggctttctgtgtcccctgaggggctgggaaatcaaggcaaccccttcgcatcacacaggagacaagcgtgagactagagggtaccattcctggtcttctctctgcctgaacactctgtagtggcttgaatgctgacccctcagatgatatgtccacatccgaactcctagaacttgtggatgtgaattggccaaagggtctttgcagatacggggctgccctgatagctcagttggtaaagaatccatctacaatgcgggagatcccggttcaattcctgggtcggaaagatcccctggagatgggataggctacccactccagtatcctgttattcccttgtggctcagctagtaaagaatccgcctgcaatgcaggagacctgggttcgatccctggttgggaagatccttggagaaaggaaaggctgcccactccagtattctggtctggagaattccatggactgtacagtttatggggttgaaaagagtcggacacgactagtgactttcactttctttgcagatataattaaattaggtctcaagatgagatcatcctgaattatctggtggggggaggctctaaacccaatgacaagtggcctttcaagagaaagtccaaggaagatgtgacatagaagagatgagagatgactcagaggagaagaatatgtgaagacagaggcaaagactggagtgatggagccatacaaaatgccaccaactaccagacaccagaagaggcaagtaacaggctgccccctagggccggagcatagccctgccagtactgagatttcagacttctggcctccaaaactgtgaaagaataaatttttaaaccacttgttacggcaacccaagaaactcatgcacatttcctgctctcctttctactctactgtgggtatggaccaaatagccctccagacagcatcctacagagttctagaagtgggcagaagtcccctctggggtttctagcttttctacaaccgctcccaggctggggctcagagagaagggtgaggcacaggcagcctcttggcatcactctttcctcctacgaatctgtttttccagctctctaatggctcctctgagaaatggaagctctgcctacattattccgagctgggcaggcatttcaccctgcactgcaccataaattctttctacccgtgccttacagtaaaactccatgttcagtcctccaagtttgcgcctggcatctgcaggaagtcctgggagcagacaactctgctttctctcttatagtaggtgctgctgattctctacccaccttctctttccctgctccatctctttaaaatgacccagttttcattccggagtccatcttgcccttacatcacccacgtgcttcaggtgaggctaaccccaacctcagctctgggggctgctctaactggtggcatggaatctatcccacgtggtccagaaacccaagcctgagtgccagtgcagggcacctctccggccacagaaacaggcatgcaacaccagccatgatgccaagggaaatatactgggacctgctggaaacaggtatttccttgctgttagaaggatccaccagaagggacatgttctccttttcccttggtgtcctggtggtgaatgtctggcaattctgaggggagccaaccccaggatgaagccatcagacagagcatagccaaggggctgctgagttctaggccagagttgctggattaagccagtcctgaagcccaccctgtctctggaatctggttacctgagccaatacatctcattgttgaagccactgtgtcttagacttactgttacctgcatcccaaagcatcttgccaatataccacttgccacagccagttttttaagactactgtcctgttatgggttttgagatcctattttgggagtcaaaagctaactaagcattgttccttattcctcttacattattattgtagcaatttttaatcctccctaaggcagatggatgcctctggctcaataggaggaaaattcacataaggaagcttgagaaaaaatacacgttactgtatttcaaagaaatgatccacattaccctaacattcacacaaaaaacctgggggaagaacttctaaactgtgagcaggagcagctgaagaggacttgggggatatgtgtctccctttctaggctagtatcactgtaatgtttgaatttctagagtaagcatgtattacacttgtaatttaaaatcctgaggattagagtcatctgaggcatccagaattccccaggtaccgtccatggctcagctgtcaatcctgcagaaagtttatttgtggatcagagcaatgacttaagaagaatagtcacaatgtttctttacaatttagactttttgtttcaacagcgtacactgatctagctgagtgcatgttccccgccacaggaaacccttgccaaatctgtgccaagtggtagttaacaggactttggtgtctcctggggtcaggagaggggctgcagctctgagtcagccacagtctgcctcctcccttccaccccaggatctctggcacaaagcgcccatgcctctgtgaggtctgaagggcctccttgcaaactccaatcctgtgtttatgctcctcctgcaagaaggatgccacctcctccttggacagagatgaggaccttcagtatctccagaggggtctccagactctgggggccagagaccacagcccagaccccagtgccccgagagccccctgctctgccccagggtccccgtcactccctaggggttctcttctcggcttagtcctgatgcaatctccaagctcaactggcctgtctctgtcatttcccccaagctgataaagccagaaacctcagagtgagtggaaagagcctctgccctgaccagaagaaaccgcagggctgaccccataccccacagtaagagctggagaggctgggctctgggctcaacgcctggggagaggaggaagaaagatgaaagagctgaagaaaagaccatttgctatcacccgctcacacctgtccaccactctctcttccctggatctttccctgtgcttggtccctggactctgtccctctctaaagcttctggctccaggatcagaaaaagcctcagtgcgagcctcagttctagaatctcaactctcagaaaggctagtatagggggcctcagcactcccctgcccagacatgcctggggtaggtctgggattccttcatgctcacctcctccattaagggctgggcacccactagaaggcatcctgttccccatgggtatccagaaccctcaaatgtcccaaacctcctcatccaccctcacctctgcctggatgggcagtagataccccaggtctcttgccccagtcagacccctatgcaccaggccctgtgctgggcatcaggttcagagatgaggcaggtccctgctgcaggacagtggggggcaggggacagcaggtgggccaatggccagatgaaagcagtcacagtaactgccagctgctcggcccgatgccagctggggacgtgatattgaatggtcacgagccccttccccaacaagcagttcaagttcccagcagtggtctgtacagaagccctcgccagatgcagcatcgctcagagaggtcctcctggttcgcaggatttaacaagtaacccctgctccacggtcctatcgccctctagcattacgtgctcgatttgctcttccagtcacccactcccatcactggagtgtaagctcttggaggcagtatctgggtcattcttacaccccagaccctgggatgctgtctgggcactcacagtgtatttgtgggtactggatgtgcatgaaaggtggttgctggattcttgtccctccttctaccctatcagtcacctagccaaaccacccccaagacctgcagaagctgtctcttctgttctgtcatctctcctcctcgccctccccagactctaaacccagcctccccagcccttccttggtatttcttaatctctaactgctgctgctgctaagtcgcttcagtcatgcccaactctgtgcaaccccatagatagcagcccaccaggctaccccgtccctgggattctccaggcaagaacactggagtgggttgccatttccttctccaatgcgtgaaagtgaaaagtgaaaataaagtcgctcagttgtgtctgactcatagcgaccccatggactgcagcctaccaggctcctccgtccatgggattttccaggcaagagtaatggagtgggttgccatgctttctccgcctaatctgtaagcccagttcaaacgtcacctcctctgtgaagccagctcagatccctttgtgggcacattgcctgtcacatgatcctactgggcgctgcagccacgtgtttatgtgtctgcggcccccgcccccaccaccacctccactgctgaacagaagatcttcagaactgggctggggcccaggtctctgcgtccagggcttctacagagaccagggctgggcataatatcagagctcaggaacgatctgtcagatgaataaaggagtgagtggagaaatgaatggatgagcccccgttagtgagggatacgtgaaggagcaggcggatgcatgaatgagcaagggaagaagctaccgagtgaatgagtcagtgacttggggtgggggggagggggagtgagcctgtgaaggagagagagccgtgagggtttcagtccgctccagcagccctggcagcagccagcccccgccacccctgggcctgagctccgtgccaaccagacctcccgatgcctcctcccagagccagctgccgtcagcaccgctcagcacgcgctcccgatgctggccagcccctgcgctgggccatgaatcagacagggcactgccccagggctcccaggacccggggcagacagacagcctcataaataaacccgatgccctgctgggcagacatgtgttccagcagtgcagtgagctcagggttggctctggagccggggctggcagggcagagcctgatggagaagcctgggagagcctcaggaagagggacctcagggctgggcctggaggagaaagggcacccggggcaggagggctggcagcagccaaggcacagtggcttcgacagacacaggagtgcagggggagggcgtggtggaggtgggaacatggggaacgcagggcctgagtggtggggtcaagaagttgggattggcagagccagggctggggacacagcaggatgtaagcagagtggggcacaaggactgcgggctggcggtgctgtatctcagaaggaaagatgggaggctatggggaacaggtctgtgagtttctagggcgctcagggctgtgtcctgctatagctgttgcataattgagcttctggcttctctccacaaagtcaccatcatcctcccagccctaatactcaccaccagcagcttgaggctttggagcacccaaattagggaggttactttggtgagaacacttccaagtgggtgtttttaagccaagattgttttataatggttcagatcatggggaagatcctggggtttctgaagcaaatcagggaatttcagaatttgacaggaaacctcccagttgaatgggtggaggccaccaattcaaagatgctgagcatcctacagtgcacaggacagcccttcacgacaaagaatgacctagtctaagagatcaatcgtgccatggtgttcaactctttgcaaccccatggactgtaaccctccaggctcctctgtccatgggattctccaaggaagacgactggagcgggttgccattcccttctccagaggatcttcccaactcagggatcaaaccgggtctcctgcatcacaggcagattttttacctctgagccattgggaaagcccagtgtcgaggttaagcaacctgctttcacaggtgggaggactaagacggtgaggatgctagaccaaaaggtggtctccagtaattcacgtgggtcttcatacgtgccaggagctgttctgagaacctacccccattcactcatgtcatctcttcctgctttgaggatgaagattaaagacatatgtgattttcccagggtcacacagctggtgggtggtgaaggcaggattcccacccggattgtctggcttcaaatgctgtgctcttgatcatgacatcccatggtctcccacatcacccagcagctgggacagagctgggcttgggcccagagcccccctctccaggcagatgttccttccactctgctctgggccccaggtccatgtaggagtcttgggctcctccaccaccacagacgtggagcttagcaaccgggactttgatttgtgagggatgcagtgggtgggcaggaggcagatcccagggacagagggcctttgtctgcctgcagatgggcaggggccagttgggtgcaaactcattagacagctgccgaggctgccaaggagacgggagcaattagcgggcttggctgaagccaggaagtggaagccgctctgtgagagctgctgagcctccctgccctccaccaggacccagctccctaggaggcagctgccaagtttatgttcagtttgataatggcagctccaaccatccttacaggttgaacctactatgtgctgggctaggcacattccatatcttgtcttttttcatctataatcacccccacccaccttgggaggctggaatgactaactccattgcatccacttagtcatccttccattcattcgacaggtattcatttattgggtgcctactatgtgccagctctgtgctaggtcccagagatgcagcagccaacacagcagacaaaagtctccactccagtggaccttctgttctggaaggggaagacaggcaacaacaaaaaagaaacaaacaaggtaactgcaacttgtgatcagggctatggaggaagtgaaggggctgatgggaggatgctggggataaaggaatcagggaagctctctctaaggaggtgacagttcacaggggagggacttgggctccgagaggaaaggtgacttttccaaggtcacacagctggaaggtggaggagctagggcttgcctccagccttgacctgggcacctgcctcacaggagcccctgcccctccaccaggccaccatccacagctgtgccacacactggcaccgtatctccaccccttcctcatggcagcctcatgaaattcgtggggttatcacctccatcttacaggtggagaagaggcccagagggggccttcacaaacccagggccctgcaaaggaatgacagacaaggggcttgagcgtcttttgatccccaaacctgtattccttctgccacacctccatccttcctggccaagcacttgacgcgcactgagcgtttagtaggccgataagaaacagatggatgcatggactatggggccttgggcatcatctcctttcagtgcttccatttctccattagagaaggcgagagggtccagaccagcttcaaaatgcccaagttcattctactctgttgacattccttgaggagcgtggtcccctatggagaaaaagatgaaagggactctgcctcccgcagactattctgggcggagcaaactgcaggcagaagcatggaggtgggaaaggaaatggcgaggagtcagcagacatgtttaggacgcggagagccacctggaactcatatctaagtgtccctttccttttcctgcattcttaccacctgtcacctgcatagggtcttaggccaccagagcttcatctcctctcaattccagctcttgcttgagtcccagagagtctcccagaggaggggctgaagcagatcccaaatatatctgtgccaccaactgtgcacagtgtgatcttggtcaggcagctggtcccctccctcagccttggtcttcctatcgattaactggggagacagtgatcagagcaagtcggtagcacaataaaaggtgaggtttatgagcacattctccatgtcaggcagtcatcccttgagacaggcaattttgttatccctgatgtacagataagagatctgaggcttagggaggtgaagtcactggcccagggccacacactaggaaatggctcccccgggggattcacgcccaggtccatctgatgccagagctctgctcataacaaaaagctcatatgaagcaatgccctgccctttgacccacgcaacactcaacccccaggactttactcgtaggaaataatccaagagagccaaaaacctgttcacagcgggcctatttacagtatggcagatcactggaagaaatctgcatgcccaacgacagggctctgttcactttagaaattaggcagcttcagatggactgtggcttactgagcaccagctcttgccagttgctccactgtaacccccaccctaaccctgcaaagtggatgttgctttctgcatcctgggtgaggcctccaagttcagagtgtgaaggattggctgagggctcacagccagtgttgggccagggcatgagtggtgtggccaggcctgttcacagccacaccccaggtagctctgttctacaagaaaggaagctaaggcaagtaagtgacccagtaccacacggctgataagcagagaactggagtttgaccacaggaactgggactgcatactctgggaccacttccccacactgccacctactgactgggaaactgcaggcgagtcatttaccattcccaagcctcctgggctcctcatctgtaaaatgagaataagattgtctgttgcgcatggtgtcaccatgtaagcagtggtaaagatagcaatggcaacactggtaatactgctattcacagtcgataccaccgggacagcgttctgccgtgaaaggaaaccttgcctgaacgttagaaggactggctgcaaacctcagctaggacacgtctcaactctctctgggcctcagtttctccatctgtaaaatgggggagggcacacttgagcatgtctccggctctggtggtctctgagcccaggaacactgctatctcgggttttccctgggactctgcctgctgacccctcatcacacactggtctgggggagcgggggcgggacgcagtgggtctgggcttgaggacacatgtactggaggaggacaaggggcccttggacagggaaatggaggttaagtcaggaagccccaacactcagcccctcaacacacagcccctgctcctggcctaagggccactcaggcagcatctgctctaggtcctttgtacctctgcatgggacctgcctctgccccacggcctcagtctctcccctccctgccagcccctcaaggagatgctgaaccttggtgaagagaaagcagaggaaggcaaggaaggaaaggctgaggggaccaggagaagaggagaaagcaccctgagaaggaggggtgaagagcatggttttacataatggatggtaggggtgggatgagaacgaggcttgggacggggtagggaggaagaagaagaggtcaacagaggggctgagagggtctctgacatttttcagagttccctttaccaaccctggtgaccttcgggtgccctctctttatgtcctgctgactggatacactgggagccaggcctttcacagaggtcatgccagccctgagggcaggcctcccacatggctccagccccataggcggccacacagaagggccaagggatgtttgcgggacaaaggacttggttcactctcccaaaggctctgaactgagaagaatgtagacatcatccaatccacctttcctcacctgccgccccaccccacccccaccaagggaggaaggactttctcagggctccaaggtggggatgtcgatgtcagggccagaaccggaacccagtgtcctgtgtcttgggcctttctccagcccagccctggagggtcccagcagcaggaagaatccctgcctctggttctggcttaataaccagccacgaggcggggctcagggcctgcggctcagctgccagtctccccaggttgcaagagcattaaatggcctcagtgatgcacagctttgactcctgagcaggcgaggctggtggcagagaatacactgatgtgacatctgggggctcctgggagcctgagccccggacaaacctccaccagcgtctgaggaacctcaggctctgcagagtcagtggcacagaggcccgcagcatccttggaattgaggcctggtgtggcagaaagaggagaggccagatgacccaccgagataccccagaggcagcaaagctgagagacacagccagctgcaggttaagagctttcaaaaactttcagctacagccaaagacaggagatcagtttgtaaacagacaacaaaatcccacaacaccctcagatatgtcctaactcatctctctgatgggctcagagctggagctggcctgctcagattcctcatccctttccaagaaaggggcagcctagccttggacttggagaggccaatgccttcctcaggccagttcttctattccctccccatccaaatgcatcaacaaatcccctctgggtttattttcttccctccttccctgcaggactccagcctcatcccatcagtggtgctcacccttcctcccaaaccctccctggctccccatgtcaacaaggtggcattcagactacttgacttgacattcaagtgtgatctgctctctgacctcaaaccctactgctcccctctgccccaaccatgactctcagtcttgggatgttcttgccacaggaactgcacattccaatctggtagtgggcatgcttttcctctgaatgcaggtgacccatgcgtctgccccaatcagtggggccatggtagaggggactctcaaccctaccacttcctggaagtgtgaccttggggaagggagtctcacttttctcatctgcaaaatgggaatgctgatcccttcacgggattcaaaggtctgggcacagtgcagatcacagaactattattagctattatttagctattattggattccctgatagctcagttgataaagaatccacctgcaatgcaggagaccccagtacaattcctggatcaggaagatctgctggagaagggataagctacccactccagtattcttgggcttcccttatgactcagctggtaaagaatcctcctgcaacgcgggagacctgggtttgatccctagttgggaagatcccctggaaaaggctacccactccagtattctggcctggagaattccacggactgtatagtccatgggtcgcaaagagtcagacatgactgagcgactttcactttcactttagctattatttatcaggatcagtgctgttattacttcgtgcggtcccacacagcaaacatcctaagcaccgggccactggcaggccccaagtctgtcaaactaacctcacatgataatattagaaacactcgcctccatctcaacttgcatatgtgaaactgaggcccaggggcccaaagcccagctaacagcagaacagaccagaagccacatctcctgatttccaagccagaactctttccctacaagctgccactactaaaagccgagttcagacgccaaactttaattgtgatagtctcagtttatacaagaagaaaaacctttgctccatataagaatctttattatttattctcacttttaatgccccaccttgaacattcctatgtaccttcagagaacacccccctcctcctcctcctaggcaaagctcactcctccagctgctctttctccccacctcttttctctctccatccctggggaagcctttatctgaccttccctggcggagccaaagggcaaatgctggcttgcctttttgctgctcagctaaaaagctgactgccttttctcactttctggattgtgttgttgttcttagcctcaagggtctaccctgtaagagaaaaccagaacctccctctccaaagcctttatctattcccagttcctcccatcttaaaaaacaaccagggaccagacaaagcaaaccttcttctaccctcttctccttcagtctggcccggtttcttggtggtgacctgttatctccaggctccatctccttggcttcatctcctactcgccaacccatggggttgcctctgctgtgtcttctgttcaggtctgcagcgactccatttcccccaggtgtgctgggctctgggtagccttcaatctgcctgatctgtctgcctcagtttcctctctgagcgctgtctcctgggggttgtctgacactgtctccccacagccctgccagtaacttctcaatgccctttgttgggctcctcctccatccaagccttgacattctgtcttgggtcctcttgtcttcccatgctccttcccttggcctccttataggctgaatttccatctctagccaatgattgctagagtccacctccagcccaaacttttctcctgaggcccaggcctgggcaccctgttgcctctactggatgtctcttgtctttttaatgattatttatttgtttatttggctgcactgggtcctagttgaggcatgtgagcgcttagttgcagcatgtgggatctagttccctgaccagggatcgaacccggattgattgattgatccaggggtcaagacagggatcaaactctccattgggagtgcagagtcttagtccctactgggtgtctctaaggtagcatcaaccgagcacatctcaaatcatctcatcattttcttttgtgaaacccatctcccctcccgagcccccagctctacattcagccccaccacccaccctatctttgaagttgaacacctagaagtccctgatgtgtcctctttctcacccccacacccagtctgtcaccacaccctgctcagtccatcttccagaagcctgtacaacctgtccaggcgtcctgagtccaccacctcgacctcaatccaaacactccacttctcccctagtggagagtcctaacgggtctctcaaagccacacataccctgtactgcattctcacagcagccagaggggtctttctagaacacagatctttccatgtcatttccctacttaaaactcattactgtctgccaaatgttctccagtgaaacctccagatgtttggcgtctggtcgcaccctccccacccaccccccaaacccggccagctctctgagcacaaaccactctgtcttttcagctttttctttcaatttgctgtatttcttcctgcctctgaggctttgctgttgctgttttctctgtccagaatgcttctccttcagcatccccaccaacccatccttaagagatgaggccaagggttgcttcccaccttccccccagggcctctaggatttcgacagctgccaggctgtttgcgctcacccctgggagcttgtggttgcttgattcatgtctgtctgggctcctggactgcaaatcatgaaggccaggggccatgtctgtcttgctcatcctaaaaccacactgtgccaggcccacagcatcccacagccccacctgcccaagctacccccagtccacaaagccagcattaactgccccagagaccaactccaggctggaattcaaggcctcacccttccaaaactccccatccttaacccctcacacacaccttccccatccacactggggagcctcctctctcctccctttgctcccccccatttttccttcatccttctttctctaatgatattcaagctcaccattctccaatgatgcttctgttccctgaccacacagcccatcttattttggattgacaggcatcctccctagcttcaggatgaaattacaaggcacttgaggttctccataatctggctccggcctacactctcagatctccaccacccacacaagagtaatctggcacaagaggacttagccgttaaaggattcttggcctttctggattcaagccctgcttgcacttcttacaaacttcaggatcttgagcgagtactttgctaaacccctatttcctcacatgtaagacaggaacagttaagagtctccacctcattgaattctgtagagattaaataaggaaatccacaagaagtatttagcccagcacttggcaccaagaagctccaagctcctttcctctatcatggccctaattggttaagaacctgtccttcccatgggtcctatgttcagaggggatcctgggtgcctttcatctctgtttcccctttgcctagctcagtgcctggtcccaagaaaactcaataaatgcttattaatgcatagatagaccacacacttggcacaagtcatctcattgttcttcactttcatgtgtgtaaatcttatctctcctaacagagtttgagcttcagggtatgggggaggtggtgctgggagaaggtggtgaggtgtcttcatgtcagagcatccagaatgggagggatctctaagctcttgacatccctgtaccccccatggtgcccagcctggagcagggagtcatgaaggccttgttgacagatgggcctgtcatattccccaagaagaaggcacgtctcccgctccgagatatcgccctaattactccctggtccctcccctccacacacacatcggctttcttaggcaagagcctgcttgacttacacacatggagttcttttagctggtggttctgagccagctcagccagtttcttcagaaactacagcagaaagagaggaaaggttttttaaagccatagggcacaaaaccagagtgagggatgggtgaagtttccccagcaaaaggccagcaatggaccagcattggtcagatcatctcagcactgttccaaaggcaaacctgatggcatagtagaagggttaagtgtgtcgggctctgcactcagagactctcaggtttattccaggctttggccctaaccttctgggtgacgctgcacaattgacttaccctttctaagctcagttcccttggctatagagtggggacaatgttagtactaggaggatttaattagacaagatatcaaagggttggctatcactatgattatgatgatttttgtcattattattataataccattgaatataagatccagaaggaacctcaaaggtcatgtgagaggagagaacactgcagccagcagaggtggcctgactttgctaaaacatacagcagatcagtgcttttttctttacctctttcgctgacatctttcagagaaccaagggagtttgctcacttacccctgaccttggagttggtcccctaccttgacttgaagaacacagatttgggggtcttgaagccaacaacgaccaaaaaaatgggcattgttttcaccaatgggccctcgccagttggaggtggcccagccactgctgacaccatgctataggatggagcatggcctctacttgctatccatccttgaggaagggactgtgggctgggttcactataggcacagcctggacttgggaggcaaggcactgtctgctcccccttctccagctgagttctgcactctggcctctccttagcccggcccaggggctctgcctgcccacctgcctgccaaatggaatccctgcttccacccatcccaaatgcctcttccccactgccctccctctccctgaggctgggaaagacctggctggtccatctagaggatggcactgggcagggggcaaggcttagggagctgtggaaggccgctgccccgggtcaagaaggcaggtctccagcaatcttcaagggaggtgtgctctcagggctgaaggggagcccaacagcactgggagaaaaacaaaaacaggaaggcttgccatccagtaggcagctactctctccttggctcaaattacatgtcattccagtcaatcttggcaatagctccttctccactgggtggtttgtgagggcggagtgggaagctacatccacagcagagtacctggaaagaagaagcttgtgttaggggtgcacggtgagagaggctgccagctacttctctgtcgaagtactaacagaggtgccccttagaatagaccttccttgttcaggtacatctccctcggccagggtggaggaagcacgctcctctcaactccccaaacacaaagccaggaggtccccgtggcctgacaaaggcttctactactccattggctacagagctggcctcagaagcatcagtgggcaaatatgcatggggcccaaaaagcttccatgatcagggcctgcgtggggcacgcatgctcaggcactttagtcatgtctgactctttgcaaccctatggactgcagcccgccaggctcctctgtccatgggatcctccaggcaagattactggagtgtgttgccatgcccttctccaggggatcttccttaaccaggggtcaaacccacgtctcctgctttgcaggcagattctttaccaacgagccatcagggaaacccttctatgatcagcactgtgtcttaaaagttgggataacccattgtctagaaaagactccaaatagctggtcccctctccatgagggaagggagggtctgaaaggaggaccagattcagcacaatgtctgggattttggtaggagagctggttctggcttcccaagtggctgaagtagaagcctctcttggcctggcatggtggtttgctttgaggccaatggctaagaaagtgctaaccttggacccaaagtgcagagatcgcaggagcacaggctccactgaaaaggagaacaagggtccgtgaagctgagcagagcacgtcttccacagcgcccccattgtcagcagcagcagttagcactgatggcctggtgaggactagtttctctcttcctgacactggaagtaggagtcttctcttgggacagagaaaccttctgggtctttctggacaagggacggcaatggcttcagtcaggagacactgaacttccattaaattccacaggcagatatttgagcaattaactggaaaatgaagacttgagaccagtcctcccaaactagtgaggtgcatggttctggttattgcatagaacttgactatctcgttggttcctcataacagctcaacaagcaggcataattatacccactaaatatatgagaaaattgaggttccaaggagtcaaagacacgtgccagttcactcagctgggaagtgttggacctgggactggaatgatctctgctcagtgccccacgagattgaacagaaacctgaggacccagggccagcgcttctcatactgactctttcctatccttcagattacagtttaaccatctcctcctcaaagaggccgctgagccccagaacctgcagtgtgttccccccaccccatgacatctatacatctggacaatatttcttcctttcttagaatattatcataatgatcataacctcatttttacttgtggttttaaaatctctttgatctgcttctctctggagaatgttttccccacgagacagcacataatgtgcagtgtgcaccactgagccccaggcccagcacagggccgagcacatggtggaaccctgtatattgtttgaaggaatcattgagtagatggttaacgggtacttgaaagcatgtcctctttggatggcatgaaaaatcaagatgatcataagagagaggagaaaatccaggagagacacaagaccccatctccaaattctaaagggctgtcctgtaactataggaacaggtggggtgggaggcacaaaactggggttgctggaaagcaggactctcaatggttagggaaactgagcccctttcgaggctcctgccctgtataagcacaccctgaccatctatcccttcctgccccacctgggaaggactccagccatagctaaaggaggcttgtcaggcctgagtggtggctgctcagggactcaaagcaaagcaggttgttggggcgggctccaaggaggaggtgagctgcagggcttcctgggggattatcaggagcaaggatctctgggcagagacatgggtctgtctgctgaaacttgctcagagcagcttctgggcttcctggtcagataattgcaaacaaaatagaccagggactgggcagcagctacaaacccctcttatataagagaagggcctgggctgaggcatgcaggagcaggcagcagggccctgagtcatacaaggaacgagacccattcagaacagctaagattctggcctcagaagctttcagtgatgatgctggtggctttgcctttctctggccgcaggcttcccatttgcaaactgagaaccactggacatccactctgtacctggccagcactggggagaaggaggcattgacactacctcccagacacccaggaaggagcaccaactgacacactctggttcagacccggggtcagggaaaggcagtggggtagggggatcagcagagtacttccagaaagaaggtggaggacccatgctttaagctctttctctgtccctcttaaggaaactctgaccacccagaagagactggaaggtggccaagaaggatctagccgcaactggccagcagtacctgggactcaggtgcctgggtttcctcggggaagtgcacatttatgctcatttgtattatgctgcaatgtacatatatatatatgcaaatcacatatttgtgtgtttgtgtatgtgaatctctatactcctctgtgtgtgtttgcttctaactaggtttaattccaactctatgtgcccatgcatatgtgtgtgcccttgtatgtttctaggtatacacaggagtccaagtgattacgtaagttatacacatttattcattccagatatttatagggtgcccattacatgctacgtgttgtcctagggctgagaatgcagaggaaaaaattcaaggtctctttcctcatgtagtttgcctgcagcataaaagataagcaataaatgagggaataaacaaatgaataaataattgcagattgtgatcacttacatgaaagggaaaaaagcaggataattagagagtgacttgactttacataaagaggttaggaaagacagcttggaaatacagaaactcaggcctcaaacaagacctcctaattcagaatctgcattttaacaaggtccttagagggtctgcatgcacatcagacattaagaaactctcattaacatacacatgacatggaggacaaagggaatagaggcaaatgccacagatctccttctgctgctcgccatgagataatagttgggattcattgatcagtttccttcttccctgggcagaattctttgcccacaaaaatcactcaaggatctgaaaccttggaggccccgcccaactaaggctaccgcagtcttcagctgttgctgttcagtcatgtccaaccctttgtgaccccatggacttcagtaagccaggcttactgtctttcactggcgttccctgtctttctctacctcctggagtttgctcaaactcatgtccattgaatcagtgatgcagtcttcagttaacttttagcctaagacattttccacctctgttactcactgcccccactgagaatcagaaagctgatttccccatgacagaatcagtaaccccagtcacactgaaacccccttttctactagcttgcccaaagacataaggagttttcaatggtcagctggcgttcttaacttccacttgaatgcaaatattcttgcatcctctagtggaaacattccttccttgggcaccaaaacttctgaccccaagtttgaggggcaggtccttaggtgggattgtaggcactgccactgctccttctgctgctcagcccctggccctgtattccagctctgggagaaatagtaccatgtatagccagctgattaagagtgaatacagcatcttataggatgccccttccccaccaccaacatcacagtgtcttttaattccctttggctctgggacctagatttttattaggtcatttcataattttataggtccattgatttcttggtaatggggtacccgggatgaccaatggatccaattatcttcagtccattggcttactcctctccctgtaaaatggatttcttgatctacagcaatgttgtatgggatatcaagacagtggatgaggtattcatagagtctgcagatggttctgctggaagaattatggcaggcaggggaagcagatccaaatccagagtaagtagctgttccaatgaagaaaaattgctgttcctcccatgaaggaaagaatctgatgtcgtctccccctgaccacgtgacagccacagctgctttgtcactgagtccactgagcaagccctggggtgaccaggaaaagacaccaacaggcatccacaggaggtcatcttgaccacctgtttcttaaagccctttcttccagggtcttcaggtttcattcgagtgagtgttcttataggacacaagtaaactcgtgatgttggatccattctgagggtccaatcacatgccttttctccaagcttctctttcaccaacccttcagtcctgtctcttcccagtccctgtccctctgaccaaatcattagccacttcccatacatcactgtagaacataaacctctgttcttccagaccgagacagtgagacacaccaaagtgctgctcactgcggggatttctctattctgtcctccagggatacctctaaatggggctgtaattacacagcctcacactctactagcataacacgcagagccatttgttaagcaggctcagaatgcttttctcctccatacatgggctatagggaattcctgtgagagcgtaagtgtctgctgagaaagatgcagtatccagcaggtgtgagccacctcttatgcaacatgcttgtgctttcaggacctgcttgggtccagaccactttaccacctccactgaaggagggagtactgttgggtgtgctcagtttaatgggtaggtggacctgataacacagttgttctcttggactaaacgattgcatcatagtctatgctcaggtggttagcctctgttagtgccaaggggcaagccaagagtcatttctcaagaggtgaacatttgccagagaaggcatggtcttgctccaaaaatgaagcatctccagccatgatgctgctctctggtcttgccaaaagactccatgcagcatctcaatctgccacaaactttcagtacctttgaatctagtatattataaaaacttggcttgaagtcttaactagctcagatcccatttaaagccaacagcttttttgctcactcaggagctggcttgaagtagaagacacaagtgtggtagatgttgcctctaaaacccaaagcagcccaccgagtgataagtccctttcttagtgatctgcgatgtagagtgtcacagcctattcttcactttgaaggggatattctgaatttcccaggctgatattttcccagaagcttaattgagttccctgtattttctcagactatttttccttcaccatgcctctccaaatacaattgtatttcaagatacttattatcttatgatctctgtgtcctacgagtaagatatcaccaggacgtctctggcagtccagtggttaagactctgcttccactgcagggggtatgggttccatccctggttagggaactaaaatcccacatgatgcactgggcagccaaaaaatcaccagtgttctagatgaatgatgaaaagatcgatgtccctatgaactaactcgttagagggccagacgtgaaattagagttgacacagcatcatggcgaagtgggaggtgcactgctgttctgcctcgagaagtctacacacttttgatgtcctctgattattaccatagaggagtgaaagtattctctgagtgttaggtttgcattaatttgttatagccacaaaaccatacttgaagcatcatgggactataattggagttaccaatatatattaatgataacaatcccacgttaatttttaagacttatctatcttacgcattggtcaaactagaaaattttgaccttagccttaagctttgtggtcccaccaaagaagtgtcattgcactgacttactactttgatgttgtttgaaaacctacagtggctttcacttaggctccatgggtcagggagccagtgtagtaaatctgccaattctggggttgtctattctaactatacacttggaatctgggtaaataaccacagatagtactgctgtgtggtatggaagaggctcagatcaacattccaaattaaaaagtttatcttatccaaataaatccctaatctaatcaggtcagtctctggggtaactgatttctttagaaatactggagtgggttacccttttgttctccaggggatcttcccaacccagggatcgaacccgggtctcctgcattggaggcagaagctttaacctctgagccaccagggaagccccttcattcagggctagtatctactaattctcaaaatatctagggtctttgcctgtactctgttaccttgaaacatgaccacatatccctttggggaaggacaagagaagttttaaggaattaaattattacccaatgtgttattacatagtgtttcttcaagggggtcccctcctcttttatacaacagactgtttctgcttattgactaggggaggttctgaaaattttccattgtgatagttcagcttattttctactcataagatgcatgtctattttattatatgaatcaatatagggcttttgtgggctctccacctcttctggccttaaacccatgatcattaaccatgtccaaaaaataaagagtgccctgttgtttgaaccattccaattaccacgaggctctgctcactatgacggtcacacacccagcctctaacctcgaagtgccaccacatggtctctgccacactacgatcctcccatttccattgacaccagggacccattcagctatggcaggctctgccaggatgcctagctcacagagcacagccattga

SEQ ID NO: 48 - DNA, 86405 bp, Bos taurus
  unsure (332)..(383): sequence is unknown
  misc_feature (333)..(382): n is a, c, g, or t
  unsure (55059)..(55110): sequence is unknown
  misc_feature (55060)..(55109): n is a, c, g, or t
  unsure (60703)..(60754): sequence is unknown
  misc_feature (60704)..(60753): n is a, c, g, or t
cctgtgggctggcctagcagtatcctcagccagaaggacatcctcagcacccactcccatgctagttcatgggctgggtccctgctctcatcccagcatttgaaatggtcagtaatcctgtcaccagctcctgggcccagggttaaatcagaaaaacttttgcatatgacttgtcttttaatctccttttgtttttttaaccagcatctcacttcctcattataccctctgtccgctcacagcccctcacccaccctacccggctcctctgtacatcgtgcacggcggccgtggctgcacccctgacctgagcacgcgggcagagtgatgtcnnnnnnnnnnnnnnnnnnnnnnnnnnnnnnnnnnnnnnnnnnnnnnnnnntccctcctccccctcccccctgcccaccttcccctccctcccctggcccccttgcccgccctccccctcctttctgtcctccttgcctctgctccccctccccttctccttcctcaccctcttcctcaccctcttctccagtcttcccaaatacaaagagacaaaggctaagttcacggaacgatggcacccacgcccctccttcttacagcacgcgcctggagccagagcacttgagcattgctgactgtcacgcaggtagagcacccggcacccggtgggtgctcagtgaatgtatggtggttacattaatacacgagtattatagtcaacatcgattgagcatccacctgtcaggcatactctagacacgtgccgtggttatcttggcaaaccctcacaatgacgcagtgaggtacatacttttatatgctccacacccacactcacacctccacactctggacatgggcttggtgctcaggtcttttagagctaggggctttcaagagacccaaagccaggcagacctgacagccccctatcacctctcaatcccaccccacgtcccagcaccacaccccagcctcagtcccccagtagcaagagtagagccatattagggccagtttctgtgaacacaaggcagagtggaaggtgagtccaagtcagcatgtctggccgggccctgtcgggcctcagcatccaagaaggaggccagagcagctcttgggggtagataagcaaccagagatattcttctgcagtgagcaaacctttggccagatcccctaaaatcagggtcaagagagtgtgaaaaagcgaggtgtgtgttcctgtgtcttgtttctttctgtttatctgatttgggaatgtatgtgcagtcttaaaaacaagttagatcatatttccttttaggtgaaatgaatcagctttattgaacagaatacactgaactcagagctgtggcctccaaaatgagaatgtggggttactgagttgatcaagaaagcacgtcaagccatttacagatgtcttattaagtcctcataactgtggtagaaactggtgtcactcctttttaaactgaagacatttattaaagctcaaacaggttatggaagttgtctgaggtcaggcaaaaaccactccatgtggctccatgccactccagtgcctggggggctggacaggggagctgcacccaagcccagagccctgcctgggtgggaggcagggtgtgttcactagcaccgcaccaggggtccactgggcaagttcagcttcattttcccagtgaggccgaaaatgatgaccagatgaccttgtttgagaatgcctgaaatcagtgcagtcgttctagaaataattcctgccagcaccagccctattctaagtcctactctaggtactagaggttcttcaatgcatgaaatatagttcctgtcctcaggaagcctgcattctagaggggagccgggtagtgaacaaatgtggaatagggcaagggccttgagtatgaaataaagcatccatgacaggtagggaagtgtggggagtggcctctctgtttaggtgatgtgagccgcgaacatgaggcagggggtcaggaagccacgtggagcctggggaagggctctctctgcaggtggaacagcgggtgcagagcccctgaggacaagagttgggaagtcagagacagctgcggctgtgaaggtcaagggatgggtttagccgcctgctggagcgactgccctgactctgtacgcagaggatggccggtagggggcgcggctggaggcagtgatgcaggctgagcacgtgttggactggggggggcggagggaggtgaagaaacgtgctgttaggttttgctgacacatcagggcgggggcaggtggagggtgaacgcatgagaataaaagatccaaggatggtttccgaggtttatggcctaggaaactggaaggatggagttgccatttcccgtgatgatgaagattcagggaggagcttgtctgttagacgcgaagtggttgggaggtggccaggccggcgccgcagccccgcccctgagggtgaggaggttgagcaccagcgccaccgtgtggccagacctccccagcgccccggcgcgcttcgttccacccgtcccttggctccagagaggcgggactttgtggagattgacagtgaggggtattaggaattattgatcggcaggggcctcccgtagagctctgcaagagcccagatgtggggggcctggcgaaccttgtgctgggcacgggaatcttggattccgtcactcctgagttgggtgcctagggcagggcaccagccctctgtccctcagcgtcttcatctgttacagactttaggatctttcctgccgaatatcaggagccgctgatcctgactccctgactggtagcactacccctctgaccttcaactgcagcatgagatgctggccgtgctgcctgtgtgttgaggttgtggggtacttggggtgagaagagctgaggtttattgggtacttactaggtgtcagaccctcacaatcctctcagcagcttcatgaggtggcttttattattcttacccccacccccaccattttacagacaaggaaactgaacccagagagaaaaagtaaattattcgacattgcacagtaaggaaggggtgggactgagattcaaacccagaccatttcctgcttctcagtgcataaaaacatttttaaactggcagtgtaatgatgtaggggttataaaccttagtcctgactcagccattactttctgggtgaccttggggaaacatttgcctgctctgggcatgggtttccccacaggttgatgagaggtgaggctaggtgaactcctggagctaaagtcttagggcaaagctttagggtatgttttgcctccccctcacgacccctgctctgtggtccccagccccttccgcctctctggtcattctgctcccagctgccaggaggtcatgcccttggcctcccttcacctgacagctccaccccgcagttttttatctacatcctcttgcatgcccgactgtcatccatttgctgagtgctgagctgtttgaaagcacaaatgctgggctttctggtcccggtgcagcttggcatagtggggtccagagaagcatggttgtaccagtgacctgagtcagctcatgtgtccagctctcttagttagtagttgagtggatgctgacatgagcgtagtgttgggccagcaggacccaaaccctcaggatcctgccaggtgggcgagatgttagcggagctctccccagagtcctgattgctgccaacttcagagatgcccaaactaggtctgtgtcctgttagagctgaccccgctggtggggctgccccagcagaagtcagaccaggaggctggtatttcagagctctactctcctccccagctgggagcaccaggggttctacaagcaccttctctggacatgagtggctgggaagaggccctctccgcaggctgaggtcagcttagccaaaccttccaagggaacagggcctgccacctgccagatgctattgtgccaggcatcagcagcgtggccacagtggcaggtgtgtatgtgaactgaccgtgcccagtgctgctggccccgccagcatggctgctgtattccagaataatagatgtctccatgaatgcgctgagtggctacagttattaatatttgagcccttgatatgtgccaggcttgtgtttcctcctcctagcaaaccttatgagatgagactgtcatattcatttgacaaagatggagacagaggcccagcagagtgacttaacttgctcttggtgaagccaggactgaatactaaccaaaaagaaaaagaaagggaaggcctgtcttgtttgctgtggtttgatgccagccttactacttactttgcctgggcaaggtaaggtgaactgtctcatcttagttccctgtctgtaacatgaagataggaatagtgcctaccgggcaggattatttgtggattaggtgaattaacgcacatgcaggccctagagctgaaccttaacatggtagatacgaagtcatttttgctgtttacaaagtgctcccataccctcaacgatcttggccgtcaggcggggtttgtggcacagagcagcgtggggtgcggctgtaacctcgggcctcctgtgtctgtccctcaggaaccagtgatgacccattccaggactcggaagggcgagagggcgcagaggccgtggcagagcaccagttttcagacctggacgactcggactcggactcggacctggacgaagacgaggatgaggacgaggaggagagccaggacgagccatcaggcccgtcctcggaggcgcccccacctggcccgccagccacgctgcccgcagactcctcacccgttcagggccctcagcccacagaggccacccggggcagctcggtctcagaagccgagcgctcggcacccagcagctgctccacatccagccaaagcatcctgtgcctcccccggctggcaccggccccccggggcccagtggagaaggacacaggctcggccctgagctcccaggccctgtccccaaggaggccgtggtccccaagcaaagaagcaggcagccacctaccactcaccccaaaacactcactaaccaaaagctactcgtctccccagcgacattcaccggcccgagagccactggcctcagccccgagtccgcctggctcccagacgggccctctcccctgcgggtccccgagactcgagctgtcgcctcttgccctccaccccctgggaagggaactgccacttcgagcgcgcctgccccccgaacgcaagggcgctgcagacccaggcccccccagacactcgcccaccaggagatggtctccaggccaggccgagtcaccaccacggtcagcgctgccagggaagtgggccttggcagggccgggcagccccttggcggccgagcgtggcccaggctcagggctggccccccgggctctctacccgcccgcgcctctacctcacaagcttctcggcagaagcccagcggagacctgcacctccacatgggtgagttcctgtcccccaagtggctgatgggtggggggccgcgagctcacacctccctgagcgtcacacccagagctggacccctgccagttcagcggttaccaataaggcgtgcattgggcaccacttacacaggcactgtgctgggtgcctgaaaccagtcagctgtgtgtcagaagcagcggagcatggactgtggagctggactaaaagaaagtgaaagtggaagtgttagttgcacagtcatgtccaactctatggactgtagccggccagactcctctgtccatggaattcttcaggcaaaaatactgaaatgggttgccatgcccttctccagaggatcttcccatccctgggatcgaatccaggtcttcagcatcacaggcagattctttaccatctgagccaccagggactacctgatagtttttaaattctggactacccagaattaaatccgggttctgtcacttacgagccgtgtggctttagatgtggtataaacactcatgccatctcctcccaccccatttccacgtattctttgagcagatggcagagcccaacccaaatctccacatctccaacatgactgccaccagcaccctccgagtcacttgagccagctccttcccatcttcccatcagcaccgtcactgtcacatcatcagtgccatctgccatcagtacactccagccaccccataggcttgatcaccgtggtcacaacatcactgccaccaccacggtcacgatccccagcactgacacgttatcatcatcggcttacttttcctctcccaacaccttttctgtcactggagtgtcacgacccaacatctctgctcaccgccagcagtgtcagcaccatcactcaagcgattcaagctccaggagtagtaccatccaggaatcttaacttggtttttaatttggggctcaagttaaaattcctggtggtgaaaaagtgaaagtcgctcagttgtatccgactctttgtgactccatggactgtgtagaattctccaggccagaatactggagtgggtagcctttcccttcaggggatcttcccgacccagggatcgaacccaggtctcccgcattgcaggcggattcttggtggtgggaggaggttaagagcctggggtgggaactcatgttcaagggtaaagttgggtcagtattgtctgaggaacaagagaggcagcagaagcaagagagagggccagcgcacagaagccaacagaaggggcagctccattctctgaaaacgaacgcgctggccagaagcgtggggaccttggttcctgagtgtgcctatggccactatagggctggagatggcccattccagagagggcacccacccagggtgccaccgttggcaagggttgggactcaatggtggcccagctcagctaggacctgctctgtgatctcgccaagccccctcctcactctagtcctcagggtctccaggtgcccagcaggtaaccctcgccttcctctgtcttcttttctgaccctagcagaaggccgagtcgccaagtccgtcctgttcacctgctcccgctcatcctctcttctcccgacccttctcggccccccatgacttccacggccacagcccggcccggacggagaacatcttcagccacctgcctctgcactcccagcgcttgacccgcgccccgtgccccctgattcccatcggcggaatccagatggtgcaggcccggccgggggcccaccctatcctgctccccgggcccagcgcggcctgggtcagcggtttctcggggggcggaagcgacctgacagggtcccgggaggcccaggagcgaggccgctggagccccaccgagagctcgtcagcctccgtgtcccccgtggccaaggtctccaaattcacactctcctcggagctggaggccagggactaccccacggagagggggaggacgagagggggcctgggcagacctcccgactgggagccccgtgcggcccaagtgcccacagagcccacgccgacgcacagcccccgcacccccccagagacctcaccccgggcacccccaggccaccgggcagagtcccggagcccccacctggagtcaccgcgggtgccggccaaccctgcggcctccgccaccccgccgctggaccgcagcagttccgtgggctgcctggccgagaccgctgctcgcttcccagcccggaggaggaacctctctggggaacccaggaccagtcagggctccccccagccctcgggaagtggggggtccgggacacctccacaccagcccgaggagcgggggccccggagcacttagcctctccctgaccacttcagcatctggtttctggtgtttggcaacagacgtttccagccgacttcctcgagtcatcttgctgtcacgggctccctgtcccatctgttgatctttccaagcagcttctgctcagcccccatctgtcttatcttcccacctcgtatgcagttacctgtgcctttttctatgaccttttgttgcttgaaaagaaacaacacacacacagacataaaaaaaaaaaatcccacgaggagactgaggctgtgaatatttagatgggacctcaccctgggccactgcgatcagcagccccccacaaagctggcaagaggcagtcagttgctgaaagaaaggggatgcactgagggagagacagagaaaaaaaaagaaacttttaaaaatatataagtaaatgtaaaagcaagcactcctatgtacagagtttatggttcctatttattgctgcttcatcccaccccagctagtggcctcccctggctgctagcagaagggtcagcggcccaaggcagagggacaggctgggagactccatgggcaggcccagaaaactccaactttccttttccaaagataaggtaaattttcctaggatttcaacacaaactgtttggagcaggtagaaggtagttgctggttgggtccccagggctcgcagacaccctggtggtctgactcgtgaccccattctggcatttgactcatagacaaatccccccaccccggcacctctactctgcactctgccctcaacctttggactggggaaggagccctgaccacccatctcccggttcctgagcacctgacctcggccttgctctcagggccccagccattgctgcgcctttgttctagtaactacccacaaggctgaagggacaaggcctaacccctgggggtcaagatccaaggtgcattgccttgccattcccaaggccaggcttgggcttcatttcacatttggtccctggggtacaaagggctctatttcctccatgactgggcttttccggtacttagcactggaagtttccaaggactcatttctggacctctttgcagcaggaccagtcctcctattggcgtgtcacacactgtcaggcctctactatccccaggaagtacccagaaccatgactggtgggaactgcccaggcctcctattggttggcttaaatctcttttaaaaaataaaattatatatgtgtatatatacatatatatacatacatatatatatatatatatatatatatatatatatatatatatatatatatagaaagagaatggtgtttgatatttcccctagcctcctattgtccgaggtcatttcaattcttctccaaagcaatcaagaataactagtgcctcatttctcatccccatctcctcctttaagaagctgccctgtgttttctggggcaaaagcctgctttgtaaaaaataataataaatagtaataacatgactagaaattaaaatcccaagttgaaatatagaacttgaactctagcatgtttacccagccctgggatatgtggggttttccccaacctccagaaattcttttcttttgtctctaccagggggagaaagcacaaggaccgtggtcacagcccagccaggctaggtgctaatgccgcagagcagggacctccttggccggtcctcattcctcagccaggctgtatgaatcctgtggccagagggggctcctgggctgttgaagttgcttagacaggacaccataaggtgcagagggctacaccatgcagaggcacctctgtgggctcctacccttgggcgtaattccctcttccaccagttcaggacttttccttccttggactctgctgccaggacaaactagccaggccacctggttcatttccctctggctaagacaaaaaggggacaatagggatgggcttccctgggagggggtggctgggccccagggtgctgaggctagggttaaccagcacttcctggctgcctgacccagggtctgaagctcttggtccccctggaagaaggctaacaagcccagccttggctatgctggcacttgtgggtcctggcagaaagctggaaggagccccggaccccagtcacagccttggccagaggctgggtttttcctcacccttgctttccaaccttaccccagggcaaaggtgagggacatgggaaggtggctgcctaaggactggagacttcaagggccgaggcctgggagctgaataaagggcattgcttcagcccaggcttgaaatcttcctgggcaagatcttccagctcccaacctacagagcagcaaacagggggctctgctagagtagcccctgaccttgggggtagccaggcccctcctccaagccctgccccacagctctccccggggcatcattcctctggtactcagacagcccaactactaaggtttccttcctggagccctagtcatggctggtggtggtcagcaggggagagtcaggcacaggcagaggggatgggggccaggagtcaccagagacccatttctcaatgacagacacaatgtgcaagcaatctggccaaaaggttgttgccctgcacaggcatccagagaaatggacttgatgccacccgcctgggctgtatgtcactgggcatggctctcaccctctctgcctcactcaactcctgctcccccaaacacagagctcccagcccgcacgcacacctgcatgataagggaaagactctcacatcacaccctcctcctgccctgctcccagccactttcacatttccagcctgcctgtgacactgttgtccctgttaagggacacagtggagaaagcagtgcccattgttggcacagacacctgtgcctgttctgctgaaatgtgcaggacagtcattcctgggtacaggctggctctggtcctcgggtgttggcagccttgcgggctggagaccaacttgctggggtttcagagccagctcttgtcatggggattccaagccagccggcccccagttctaccctccaggatgcccttcaccctcaggacaagctcagggtcattctgggcactaacctgttcctctccaaggcaccttttacaagcctacttcccctgccccaccacccaccaaggccccgactactaagaccctccaggaagtcaacagcagcgaactgcccactctcccacctccatcacctccaacttccagacccagcagtcccttcacctctctctgtgttaacaagtctgaaagatttaatttctgggtccaggtagcccctgctccatcctcacccaacccttttgaataagaataatcaagataactaagctgaattgctttctagtcctttctccagacaaaacctcttcaaaataaaagtcctgcctggacagtcgtccttggagacagatctgcagcactgaccaaggggagaaagttcccaaagacctgttccaccaattctgctcctgagtcgtgaatcctgtctgctttccatcagaaaactgcttcggcacttatgatcactttactaagcctagtgttaaaaaaggaagagaaaagaaacagaaaaaagaaatgtataggcaaatgtaagataacacgctctctgtaagatagaaatttgccttttttttttttttccctaaaaggtgtatgtattctgtatgtgaaattgtctgtagagagtttctatgttcttaaatggcaatacattccaaaaatcgtactgtagatatgtacagcaaccacactgggatggggtagttttgcctgtaactttatttaaactccagtttctctacttgcatcttgcaatgtcggtatggtatatatatcagtgcaaaaggaaaaaacaaaaactcccacaggtctaaagcacagagtctgatgtacaaaaagaaaatactgctcagtattgatgtgtgacctttgttgtaaattacatctgtactgtgaatgagaagtttttacaagtataataattgcctttattatagctctggctgagtgttcagcctgaggatattttttaaaaaaaaaacagcacgttggaataaatttgaaaatcccaacagaggcctgcttgcccggctcatgatttttcttagggctgtagaatgtcagagctggaaggacactccgagtcccaagtgctttttctgctacagagaaatcagggccagggaaggcgagtggccaggccatagtcacatagcctgggattccaagggcccggcccttccaggcttggcaggaggcacgggtacatggccatgtggtttggggtctgtattcatttcctagggctgctggatcaaatgaacaaactaaatggcttaaaacagcagaaatgtgttctctcacatttctggaggccagaggtctgaaaccaaggttcctggggaggctctgagggaggatctgggccagacctctgtcctcacttctgggggctgcaggccatccttggcctttggtttgtcatcacagcactctcgtctctgcctctgccttcgttctcgctgccttctctgtgtgctgtctaagggtcctcatcactggacttggggaacacgctcattcaatatgatctcatctctagatctttaactgaagtatatctgcgaacactccttttctgaaggaggtcacacttacatgttccagggtttaggacatggacttacctttgaggggccaccactgagcccctcaaggtaagacctggaatctgatcgtgacagttattcactgcctgtgtgacactgcgcaagttacacaacctctctgggcttctgtttcctgttctgtgaagtggagggtttcctgtgaggattaaatgagagagtatatgtgctaagtgctaaatcacttcagtcgtttccgacttggcgacactgtggactgtatagctcaccaggctccaccatccatggggatcccccaggcaagaatactggagtgggttgctatgccgtcctccaggggatctttctgacccagggatcaaacctgcggctcttatgtctctggcattggcaggcaggttctttaccactagcaccacctgggaagcatgcatacagcatggttaacagaaccttgaatatggtacggcgtcaacaagtgtcctctgagcagacctcacacagggtgctgtggttacaaggatgaaaaagtcaggtataggtccccaccttttgtatgcaacaatgacttgctctgcaccaggcagggactaatcatcagatacaacagtgagcaaatcagacagccctgccttcagagaactttcattctaatgggagaggccgtccttaagcaaataacgacatcatcaattcctcagtcccagtggccgtagttgttgctacaggagagaacaaagctctcacacagagtaagtcctaaaactcctgtgggctctggagcctgggtgggttgtggggagggctgcaggtggaggtggagtggaggggaagccatgataggagcagacagaagaagaggtacgtggacaaatcaagagaggccttcggggtaaaatgctggacacaagtttagcactaagaacctaagagggcctgcttgtttcagcggcaggaggatcattgctgacttggggaaaagccggcctgttccagcgcccagtctgcaggcccttcgtaaacactgccagtgctgaatggattgtggaggcagggggtggaggctggagagtgaggagaagagggaagtggggacggcagacccagacatcctccccaggacctgaggggagggcaggggagagctgggcagcagctggagggcagcaaggcgtccagggaagaacggagatgggaatgaggtggtgagaccccagcctgcttcattaggaggagatgtaagtaccagatgcagaaatttcccccagtgtgacccaagggaagaggtgcaagtgataacagtgaccggaagttgagaacatttccgccacggaattttctctgtcacctgctgagaagggaagaggaagctccagtatggggtagggggtgcggagcgggggtggtgtggactaaagacttgagaaagaaaaggttggaaattgtctttgttcattattccagaggcaggacagttgtggatgaaggcagtgtggaccacacaggcgtgggtgctgggcacaagagatgaaaaggctgggaagcgagtatccatggtgccagtgacctgaatgttcatctctgctgaccacagggctggactggaaacccaggctgtgagctaggcttcataatccaggatatgggctgtcacgctgcagaaacaagcaagccagaaactccagaactgaaaacaatgaaagttgaactttcccctctgccatctgtcccatgtgggtcagcagctgaagtgtactcatcctcatcatttggagacctaggctgctggacgctttatcccgtgttcctgtgacctcagaggcagaagaaaggagagagctgtgaaatgttgcattgacagctaaatgctctacatgggaaaagacatctctcctttcaaatttcacctgccaaagcagatcatattgctgtgcctagtgacagagatgaggaatatgtgtgacagtcacacaaggatacgacttcccagtgtcagaaacacccaagggctgagcagatgtcaatgatgggatgggggcagggacagggcctcatggcatcggcctcaaaggtgctgggtttttacagggagtgaaaaaaataatggtgtgcaaggaggcctggaagaaaatggcccctggcattttgatcatggggtgtggaaggcaaggagcagctgtctgggagcgagtccttggggagatcctgaatttcagtcgagaccagtgggaaagtggaatcccaaaaaggcccaggagaagaagagcacagaatggagccaagtccggcctccagcattttacaagccctatttatagtccttgggcttccttggtggctcagtgaaggaagccacctgccaaggcaggagagataggttcaattcctgggtcgggaagaacacttggaataggaaatggcaacccactccagtattcttgcctaggaaatcccatggccagaggagcctggagggctacagtccatggggtctcgaaagagtcagacatgactgactaaaaacaacaatgtatagttcccaacgacaacccagggagatgagacttacggtccccatttttagagaagaaagtggaagttccaaagagcccccaccaaggacttcctgctaagactctgtgctcccaatgcaaggggtttcagatttgacccctgttcagggaactagatctcacacgccccagctgagagtctccacgccacaacgaaagattccacatgtcataactaaagatccgacaagctgcaaagaagatccaggatcctgagcagatcctggaaagatccactttccaagttacaacaaagactcggtgcagccaaatgaatacaaataaagaaagaaagaaatattaaaaacaaaaggacccccaccagccaaagatgcagggctggttagaggctgtgtgagactgactctagcctgactctggtgcagcgcctctgggagccccaagttcctccctctcatctcctccctgtgctctggccccaggggagccctggatctcagactcttcacctccttctccccaggaacccaggggaagaggcaggcccaggccaaggcttcttcccagcagctgcctggcttctcgcagccatccaggatagccccgtgtgtccccgtgtctgaggctgaaggcgcagggatggaccatcagactcaggggctgggattccagtgctcgagagcatgccaagtgcatgcaaactctctgaagaacctgactccccagcctgctgctggcacccaggcccacctgtcactcacaccaagcctcccatggcctctcgtattcacgaggcaatttcccttttggagtgagggagatagggcacctacttccacttcacagaagaatagatcccaagattgcaccctggcaagtggcagggccaccgacccgggtcacacctgacccagaacctcaggaaggcttgggctgagccttgccactgcccatcagggctgggccttctccctaggcctagaccctctctgggcttaagacctagagaccatgcttactcctagagattcccagggacaaaccacggctggcaggatggcctcagaaggcaggccagcctgagatgggcatgagcagggagaaacaggaagcaaaaagagtcaaataaggatgggggcgactgaggagggagcagcccagggctgccctgcgtgggactcatcactgccatctggcccggggagagacttatcacctcgtcactttgtagaggaggaaggctggggcttggacaggtgatgctgctcataaggccacagtggtcaggggcagagcagagacttaaaaccaggcccacacattcagggagtggttgggactatggaaagggaatctgggcctcttggctacctcttagtcctgaaatctgggttgggggaccccagcagacatatcctttaattccatccagcctcagccactttacagagacccagctaccaacctcccccttttataaatgagaaagttgatgtccagagccgggaagagcttggcccaaggccagagctaggattcccgaaccctcagcagagccacctggaccactccgcccacccctccttaccccaggcccaggttcacctgcccagatctgcctttttaggaaaggaaaggagcagccctggtgggggcaggcgggtgggcaggcagccacgctaatccactagctcccggaggctctggttaccgtggtttggggcccgggcaaccctggctgggagtgccagcccagccaatcggtgctgccgctgagctactctgccagagccatacaaggctttgctgcagccctatcttgagccaccacaggacagccccagcgtcggcagccgccccgcccgggagcctgccagcccggcacgtcctcggactctgcctaatccaacctggaagcaggcagggctgcagcgcacgtgcaccgggcccagggttccccaaggccaggaaggtggcactgccagggcagaggccagaatcggggcaaagacctagccgggcatcggagatcctggctggggtcagggatgagctcaggtctggtccaggctgagctgtatctctctgtaagatgctcttctgttcccatcacccctttggcctgactgactgcttatccttccccattcaccgtggagacggggctcagcacagtgagtatctggtcccttctgaggtcttctcagggtccaagtcccaactactctaacccatccagggtctgaggctgcatgcacctctcagaattggggcgtccatttctaagtgcacgttgtgagcatcaggcacatacagccccccctgtggtctttgggggtccactgtcactgccatggatctgggccttggctgtggaagcaggtggggaccggtgacccctgcccagtggagcccatcccatctgtcagtgcataacacctgagtgttatgaattcacaggacccccgaggagtggaaactattggccctgtttggcaagcaaggaaatcaagtcacagagaagttatttgtctgaaactggagtgtcaggattcagccccagagtggtctgactctagatctctagaaatttccgatcctggagggaccaggggctgccatttacactgaagtgtgaatggaggcgagaaagtcattgtctgagataagaggaccctttctttaaaatatgtatctttttattctttcgttgtttttggctgtgttgggtctccgttgctgtgcacaggattcctctggttgtgacgactggggctactcttggttgtggtgcatgggcttctaacagcggcggcttctcttgcggagcacaggctctagagcgcacgagtctcagtagctgtggtgcacgggcccagttgccctgcagcatatagaatcttcctggaccagggattgaacccgtgccccctgcactggcaggcagattgccaaccgctggactatcagggaagtccaagggtgccctttgttcctgaattgggtagggccaggcccccagtgcacggccattgcccaggccctggtcaggttgcccacgcatgcagcggcccctgcagagcgtcccaggccaccactgtcaattagatttgtcacggaagttcactgggttccaacatccttgtgtgtcctacgtgggccaagttgagctcaaagccaagactgcggtactccccagggccacccggcaggtgagagaaacgtgccgacctggggggtggcaggccaggctggcattaggctctgtttgctcacccaagaaaggaagagataaatatagacacaggattactcagacacagcctgggaaaaccggctccgaacctcgacttcagccctggcccggtctcaccttcacccgcctgccccctcggtgtctgctgccaggcctgccccacctgttcccaggacgccccacctgcaaacttcaggacagccgttcctgcctgccttctgggggcaggacagaaactgaggcccagagagagcagggcacccgcctcacatcccacagcaggttaggagctggtgacgcgagggctgcactgcgggagtcagtttatcaggtccaggcaatgcaccagcccagattcggtttccatatttgtgagatggggacctggtacccccggccctcaacgccctggagcctgcgtgtagggtagagttggagaccacgcagcagaaaggggatgaagctggaggctcaagcacaggaaatgctggcccaagccgcatgtgtagggcttcagcactgggactctggagccaaatggcctgggcttaatatccccctccaccattttcagccaagagatttggggcaagtttcttaacatggtgccacaatttcctcatctctaatataagaataataagaattgttattctatacaataaataatatgtacagtattatttgggcttccctgggcggctcaatggtaaagaatccacctgccaatacaggagacatgggttcgattcccgagtcaggaagattacctggagaaggaaatggcaacccacgccagtattcatgtgcttagtcactcagttgtgtctgactctttgcaacccttttgactgtagtccaccaggctcctctgtccatggaaatcgggggcaagcatactggagtgggttgccatttcctcctccaggggatcttcctgacccagggattgtatcacatctcttgtgtttcctgcattggcaggtgggttctttagcactactgagcaaccagggaagcccaaataatactgtctataatactaaaatcccatggacagaggagcctagtggactatagtcgatggagtcgcaaagaattgaacacaagtatgatgttatatatatgtacatgtatatgtgtacgtatatacacgtacatatatgcacatacacataggtattgatacatatatacatgtagacatgtgtgtctacccacatttgggtctcgcaggaggtgctagtggtaaagaatcctcctgtcaatgcaggagacataagagatgcgggttcaggtccctgggtggggaagatcctctggaggaggggatgccaacccactccagtattcttgctggagaatcccatggacaaaggagcctggtgggctatagtccatagggtcataaggagtcaggcatgactgaagtgacttaccatgcatataggcaccggtattcttgggtgggaaatcccatggacagtggagcctggcgagctacagtctatagggtcacaaagagttggaaatgacttagtgactgagcacgcaggcacatatatgtagatgtattatttacatatcattacaataataatagcctaataacaataccaacctctcagagtgttggggtggattaggtgagattagtacaaagcacttacccagggcctgacacagagcaatgactccacatgcatgtttatgatgatgcagccactggggcaggtgggggcctgggcgcaagaggcgtgggtgggcgtctccaagtctcctgccctccaagggaagagctcagccctgagctctatggtgcgttggtctctcctgcactgtgacccttgcagcagctccctgctctgcctgaaagcttcaagagtcaggcagacatggatttgaaggttggctcccacttacgggcttcccttgtggctcagctagtaaagaatttgcctgcaacgtgggagacatgggttcgatccctgggttgggaagaccccctggagaaggaaaaggctacccactccaggattctggcctggggaatttcatagactgtaagagtcggacaaaactgagtgactttcactttgccaccacttacagactgtgtgaccttgggcaagtaactggccctctccaagcctcaaaatccacttttatccctcttgggattggtgtgagggttaaatgggggaacaagtgcgaaactctcagttcagccaggcaagtggactctctatgcttgagctcatcctgagccccatctcttgtttcctccagtttctctcagtggctatgagctgagcccaggacaggtgcatgaccctctgggtgcatgaccctcacacatgcaagggttctcagttatgggaaacactcaccagcccctacatcatgcatgagctcatgttcctgcccttgggtccctggagccatcagagatccgcaagttccccctgtactcttcatgcactcgtgcatatccacacaggctccctctccacattcctgcacacgcacatgcgtgcatctatggacacacagggcacagctgtgtgcgagctcggagaggctggtgcccacaggtgtgtccctgcacacctcaccagcacgcacgctgccacagtcaggggtgttctagccaggcctgccctagccaggcctgcccctgaggtggccgtcttcacagcagaggaatgcagacagctggggatgctctgccagcggacgtgagggagaggcccaggggaaaccacacgggcaggaatccaggcaggcgttccaggccaaggtggagtcctaaggtgtcaggaagtgcggggggggggggcatgtgcagactctaacttgctccagtctcctctctcatcaccctgtgtcctcagcctctaggacttggaggccaaagggttgcacagaccaccgttctccatccaagacagccagccagctctacctgcacagccttgctgcctagcagagcactgggtctctgggctgcagtggcctggtctcagctagaagggatcattcttggcatagggtctttcttcctcactggggaagaatctatgatcacagaagaatctatggggagaatctatggggagaatctatgacccagaagaatctatgactgcagagatcagcagaagaggagtgggttttttttttcctcatttttattaacatatagttggtttacaatgttgtattagttttcctgtatagcaaagtgaatcagcaatatgtatacatatatcccccctttttcggatttccttcccatttaggtcaccacagcacactgagtagagctccctactccctactactaataagtagattctcattcagttcagttcagttcagtcactcagtcatgtctgactctttgcgaccccatggactgcagcatgctaggcctccctgtccatcaccaactcctggagttcactcaaactcatgttcattgagtcagtgataccatccaaccatctaatcctctgtcatccccttctcctcctgccttcaatctttcccaacatcagggtcttttccaacgagtcatttcttcgcatcaggtggccaaagtattggagtctcagcttcaacatcagtccctccaatgaacactcaggactgatctcctttaggatggactggattggatctccttgtagtccaagggactctcaagagtcttctccaacaccacagttcaaaagcatcaattctttggcgctcagccttcttcacagtccaactctcacatccatacctgactactggaaaaaccatagcgttgactagacagacctttgttagcaaagcaatggctctgcttttcaatatgctatctaggttggtcataactttccttccaagaagtaagcatcttttaatttcatggctgccagtcaccatctgcagtgattttggagcccagaagaataaagtctgacagtgtttccactgtttccccatctatttgccatgaactgatgggactggatgccatgatcttagttttctgaatgttgagctttaagccaactttttccactttcctctttcactttcatcgagaggctctttagttcttcttcactttctgccataagggtggcgtcatctgcatatctgatttctcccagcaatcttgattccagcttgtgcttcttccagcccagtgtttctcatgatgtactctgcattagttatctattttatacatagtatcaatagtgtatatacatcaatcccaatctcccaattcatcccccactctttccccttttggtgtccatacatttgttctctacatctgtgtctctatttccgttttatagatgagatcacctacaccattattttcagattccacacatatatgttaatatgcaatatttgtttttctgacttcactctgtatgacagcctctaggcccatactgtcatcattggctcaagtcagagatgacggagacaatgtggaagtcactagaactcttcaggcaggactcatactgactcagcagccagtgtatgttaggtaaggcacttgcatctagcaactccctgagtgcttacaaaagggcctctgctcccatgtacagatggggaatctgaggggcagaggcggcgtcacctacccagatcccctagctggctgactccagacaccagtacgtaaccactgggccatgcggcctctgtcaaagggcacatctcacaccctggaggagaggtttgcaaatgaggctgaaacactgctggcacatgaaagccactgtcccacatgcaggggcagcccagcccaggtggcagagagggctctcccaggtcacagctacatagagatggcagggggaggctgagagccatccaggcttttggcgtcttctggcagcacacatccctggggaccagctgaagctggggaacatgtcagtgttccaagaaatggcaggcacgaaggtgggacatggcctctgcaagttcagccctggggtggagagaggtcattctccatcttcatacagaaaacatggcctaagagggacagagaccaaaaagttccagaagagactgagcagggagaggggctgccagcggagacctgcctccacttcctgaatctctgaggccagggtgacaagtggtggcctcctgtgaaaggcccccgagccaactaggtccctcaccctccagctctagctatttgctgggtggaactgctggggaggagcatgctaggccctggtgctcaggacctcatggatgagggaaggaagaagggagtcagtgcttgaaaaaagtccatctggggaccttccctatactccactggccacactgcctgccccctgcaggttctgtttacagacctggccatttatttacttgctggggagcaaaaatgggaaaatgacagtgctgtcatgggaggacccggaggcaaatgacatgcccaaggccacacagggcagaggattctgacttgtcacaactgctgcttccaggaacacccagatgcgtagccccaaggcgtcacgctacactcaccggggctgccctggggagccgagcctgccctccaactctctggaagaacagggacccaggcacactgcccccggggcagatgactgcacttctctgcgcctctggttcttcaaacagcaatgccttccactcaaggctgttctcatcatccgacggcatcgaacttagatcaaagcatgacctggcacaaaaagcctctcaggcgcctcccctccgcccgaagtttccaaagacttctctaggcctctgcactccttcccaaggcacagctggacttgagacctcgttgtccagcacgagactcaggggaggaaaacaaaccaagaagccagcgtcaccccacttgtcagctggacagacccgcggtccagagaggggcagtgacttgggggaggcacacaagcaggcaggacttctcccataccagcttcatggagagaacaggccttggaccccacgtagtgtccccaggggaccctgggggtctcgctgtggctaagcggcctctcatcccacccaccggccctgcccccaggggttgccgtcctgtgacccacacagggcgctcgggctgccagggccttttagagtcagagccgctgagacttgggaagggggctggcctccctgaggtctcctggggtccccagcagggcagctaagacctgagtccccagcggcacgtggcggcgctgcccgatcggtgatgtcaggcccaccacacccgggccccagcacgttccttctcagagtcggcagagcagagaacaaagcgtcctgcgcattcttgcacgctgactcatcgcctgcacgtagagccacagcagctgctttgcccaaaattggtcgggaggcgggggcgcgccagacatggcagcctggggtcctctgctcactcacctgctccacactctccaggagcccccagtcccaggatttcccaaaacaggcaggaaagcaagaggcactggggggcatgctgttccccaggatagccagggctaccccctgggggagggctcgtgatcaggcacaggtggcaggctggggataaggcgtagatgcaggcactgcttgtctttgagcctcagtttcctcatctgcaaaatggggatgtgccagttaccattttaagcgtttgatatgagttcttttcccatattcttacaccaaccccaaatggaaatactgttatcatcatcatctcacaggtagggaaactaaggcacagacactgatttgcttgaggtcaggtgctagtgggcttccctggtggctcagtggtaaagaatctgcccacagtgtaggagaggcaggagacatgagttcagtttctgagtggggaggatcctctggaggagagcatggcaacccactccagtattcttgcctggagaatccatggacagagcgtctggtgggctacagtccatgggattgcaaagaattggacacgactgagcactcacccaggcacaagtgctagctagctgcagaggtaggatttaaatatgaattgtaaggttccagaatctgcatgtatcccctatatgctaaaatgcggattgaaatatctggtgcccagcaggtgttctcactgtgccctgacccttggtggttgagcctggtccctcacttcacctcactaaacctctaatccctcacctgtaaggtggggtaactgtgaaggatgccctcaagggattgtcagggaaattacactgaaggttcaagtgtgatctgtggaagaaaaggtagatttggttcaacaagccttcaaaccacctttggtcatctaggccaataccaaagtacagagaggagacgagctatgcctggggtcaccagccaggccaagccatactcgtctgggcctccccaggagtctggggaacacggagttgcctgtactctttgggaaagtgagggagcaggaggggccctgccatattccctctgccagcctggcctctcgcccccgacagcctgatttcagagaaggtggagttctttggatctgtcctgtgtcggggtcagaggcttgccctgagtttgtaggaatgaggtggccaccaggtggctttgttctcagctcttacccaggttgcggtgtcccccatctgaggcttgtctgatagtccagagaaagccctagaaggaattcagcacccctaccaccaccagcccccgagccaggcctggtctgggtcccagcgggtctgggccaccacggcacagatgcgcaggactccactctgtgcgctcagtcgctcagttgtgtctgactctgcaaccccatagactatacatagccaatcaggctcctctgtccatagaacttcccaggtaagaatactggagtgggatgccatttcctgctccagggtgtcttcccattccagagatcgaacccacggctcctgaatctcctgcatcaacaggaggattctctaccactgcgccacctgggaagactccactttaagctcaggaggaggtcagctcgggctgggtgtgcacggcctgtgcactggcctccaagctcctttcatccctgggtcctgcacactctttgctccagctcctagcacgtgccatgctcttccaggtctcccagcctttccccatcccatacctcttgcctggaatgccttctccaccttcagagcctcttttggatgcctcttctgctggaaagccatcctgacctttcaggaagaggcaggcactcattcctctggggtcctgtagctctttgtcctccctctttggccaacagaaagactgacacagaacacacactggcccttatcccatagacccccccccccgctgggtccatattccaagaaaaggccttcaagggccctccccccaaatcccaactgggacagagacccacagacccagcccaggtcttgcagagcaggctcagcctgtctactgcatgatggcaaaaggcacagcaaaggcgcctgaactcccatctcttctgctcctggctgtgtggccttgggcaacgcctgtagcttctctgaacttcttcattcccaggccttgccttgcccacttcccaggcccgtttggaagatcaaatgaatgaaggcagagagaatgcttggcgcgtgggcacagctccccacacagctgtcattatcaccgagtcattattacggacctgccttgtgcctggggggggcggtgcctccaaggctgggcagcaggcgggcaggcaggcgatgaactcagaagcagccgcagcctgggctgactcaggctgaggcactgggagaagtgggtgctttatggtcagcctgagccagcccagctctggccctctcctcctacccccaggcgtcacccaaatctgaggccacaaggccttccaggccctttcagggcctcttatctgggaagataaaggccccctccccttgaatggtggatctattcaaatggcttctgtgtgaccttggcaacagtcaccctctctggaccaggcttggggagttccggggtggggggcaggcagtgacctcaaaaggctcccagtgtgtcttccaggtgcttagtggggggactctcccactgctttgggccccagagggatggctcctgttctctccctccctgacactgacctgctgctgctgctaagtcgcttcagtcgtgtccgactctgtgcaaccccatagacggcagaccaccagactccgccatccctgggatcctccaggcaagaacactggagtgggttgccatttccttctccaatgcatgaaagtgaaaagtgaaagggaagtcgctcagtcgtatccaactcttcgcgaccccatggactgcagcccaccaggttcctccgtccatgggattttccaggcaagagtagtggagtggggtgccattgccttctccaggtgatggaactcccagtatcctccctagagtctggagttattatttttatctgacacataagaaaaatgaggcccagagatcaaaagaccctcacctaaggcagcacagtcaacagccaggacacaggcatgtgaccctgccagggtcttcagggcccacctactgcaatcctctattctcctgtggcctcctggctggcgacggctgcctctctctttccctccctggtggctcagagggtaaagaatcggcctgcaacacaggagacctgggttcaagatcccctggagaaggaaatggctactcactccagtattcttgcctggaaaattccatggacagaggagcctggtgagctacaatccatggaattgcaagagttggacatgaatgagctactaacactctttccctacaccctaggacaccagctctatgccaaggcttggacaacagtcaccaacttatgagatcttcacatgaatgtaagacagaggaggaagtcaaagctcagagagctggaattgcttggcctggtcacacagcacagtggtggctggaggctcagtctcccatacctctgctctgtgccctagaacagctgctaccccaggatggtaggggtttgaccaggcctcagggagcctgcagggcagccctctggtttcacagacaccccctggctatgggtgggccaaagaggaagggtacccatcctgccaggatggacctaccaggcccacctgggcccgacgctccttgccaggctcagatggaagcatgaggtcattgggccatccctgctccctgttggctctcgctgctgtgactcagccctgtcttccccaaacctccttctccagggaactctagcaatggtctggcctggccaggtctgctcccgctgcctgtccaccctctcagggcctcccagcctgagtcaccgctcacctcaccacctggcacaatgctcaccgcataaacagactattcccctcccccaggctcccagggttcctctccctacagcccaggagccaggctgaggggtgggggcacttttcctgctgtccccagacttcggccctgaggtccatccccagaacctactttcagggactctctggccttgataggaaaatctagaattgagattgaggcctcagcccagggctcagactgacctgggctcaaatcccagctccttccttgttaggtgggtgaccttgtacaagatacctccatttgaaggagggcaacagtaaaaccagctgcagcccatgaagatttcctacagcatcaccgaggccaggatcctgcttaaaaatgcaggtggctctagattcaaatggtggtatggcctcgcgtaagccactttgcctctctcagcctcagggtccttacctgcaaaatgggaacgagaggaagagagccctcctgctgtggtgactaaatgtgataagacatgaaaaaggtcaagccgtgtctggcacccagggaccaaacacgggtaaacgtttatgtggataaacggtagctgtaattaaatcttaaagtgacgtgtgcataacacatagctcgtgggaagctgccacatagcacagggagctcagctcagtgctctgtggtaacctagacagtgggatggagggggcaggcagagggagatccaaggaagaggggatatatgtatacatatagctgattcatttcactgtatagcagaaactagcataacattgtaaagcaattataccccaattaaaaaaaaaaaaagtgccaggcgttaagtgatcccaggatggttttaatgaatgatggggagatggagagcaatggtctggctcttcactggatgatggagtagcatcagggaacggcttcccaggttggaaagctccagcatcccctctgcaggttgaccaccccacttcccttagtgggtccagaaggctctctcaagagtctttctggctggggctggcctcacagttttccagtttccaggccactcaagaagcacttcactttacagaggacaaagctgatgctcagacaagggaaggggcttgtctgcagccacccagctggaagctgagcccaagcctgcacttccgtgttccccttcttcccagcctgggagctgcctccctggactggggataccctcacctcccagtctcagagagcactctgggagagtctcagagcttgtctgcacactggagactctttatctttgtctctatcttcccccgtaatgctcgagaggcagctccttgggccatggggccagtgaaagaggagaggacccaggagaaaacttctgtgacctcctcatttccagttcaacgggtgatgtgttgagcatgtgatctgaatgagggaacagaggctgggggaggtcgcatacgtaaagggtgaggggatagaaataacactgaccctggggtcaaacagacctgaattcaaaccccaaccattacacgtcaagctctctaacttctcagaatctgaagttgcatctgaaagcagatgccttgagatgcctcaaagggttatgctgcaaagatgaagtgagagcaagagtgtgaccaggctccgtaaatagggatgaaagtgaaagtgaagtcgctcagtcgtgtctgactctttgcgaccccatggactgtagcctaccaggcttctccgtccatgggattctccaggcaagaatactggagtgggttaccatttccttctccaggggatcttcccgacccagggatcgaacccaggtctcccgcattccaggcagatgctttaacctctgagccaccagggaagcccgtaaatagttatagtcagtaataatgatggctaccaccgatggagctcttcctcatttaatccttacacagccatgttactgtgattatacccattttacagatgagcaaactggagctcaaaaaaggaagaaagggcatatgtgatggggaagaaggggtctgacaccagaaccagagaccttagctactagccagccctcagagacataaaataaagcctagccagaggtggttatgggcgtgtgtgctaagttgattcagtcgtgtccgattctttgtgataccatgaactgtagcctgccaggctcctctgtccatgggattctccaggcaagaatactagagtgggttaccatgcccccctccaggggatctcctgacccagggaatcaaacctgcatctctatgtcacctgaattggcaggcaaattctttataccactagtgccatctgcaaaggtggctatggatgagaatattgtgggtgttcagaggtgagttagatctcatgtcttggatggagttgggaaggctggtccatggggtcacaaagaatcacacatgactgagcatgcacgcacgcacctgggggaggcaacctttttgatgggccttgagtttgggcaaaataaatcaagtaagaatggaaggaggaggaaaggcccaccttgcacagaagttgggaggcgagaaagtgtgcagtgtgttcaggaagtgacaagcctctgggaaaaggaaggaaagacaggtccaagtcaggtcccaagcaggccttatgccaggtgggcatttggactgaacaagatgcttcacgctgacaccaggccaggtcctggctccagaagcctggttttcataggaaggcaaattgacccaagtctcaatacccctcatgtctgttgtggcatcaggtactgtgccaaggcaaatgtgggtgagtggagcaagccaggctggccttgggcacctggagggactgtgtgacccagggcagtggaagggatgctcgtggtgcagctggcacatggtgtatagattcacacactttctactacatcccccccaacacacacatgcacacatcactcttttgcaggagtgtgtccacaccaagaggcccacacacaccctgcagcctgaggtgagggagggagagatagcagaggcctgctgaaagaaactcctgtgccaggcaatgggccaaagcgtccacgagctctgccacaaagcctccttgcggctatgaggtaggacttttcttcttaggagtctcggatggatgtgacctctgatactcaggaaaattaaacagtgctatacgcttggtcccaaggttggtgagcagcaaaatgaaagcacagactggctgcccctgccctgagctccgtagggcctgacacagtgctgggcactggggataagtggaggattggagtctgagtcacagggctttgaagctggcagccagagcagcggagcctcagagattccaggggtgggctggcccctgactcacccccacaccctgaggctgccccaggcagtggctttagctcctggccgccctcctgcctgccagagcccagcaaggcctcttctgagtctgtcatggctcaggattcccaggagctgggcgggcagggccaaagcctcaaggcaaggaggtatcctgggcacacctctgctcaggtatgtaggcctagagtcacagtgggaaccccggacctcaccagcctgatgtcagaggcaactaggcacttggggatagctgttaaatgaagaatgaaatactgtatttctgcatggcccagactccgggtggctcaccccttcccagagggaagacagccgcctggtgaggtgctgggtgcgccctggaaagtatgggttctaggcaacacggtgggtgtgactctgcaaaaccaccagctgcgtgtcttggctggtggtagtggagggaggagaaagctggggttccagcccctccaagtgcaggggcctcagagatgagaatccaggcattctggatctccaggatctctggtgggctgttccttctccctgtacctcagtttcctcatctaggtgtaggccaagggactttccctctctggctgcctgtcttttgcttttagaaattatgtccaagccttcatcgttagagcattttgaagatgtaatcaggcagaaaaggggacataagtcttcttcatcttaagcggtgtctctgcaagggcagttttgtctgatgagattaagtcatcttgtatattcactccagccttgggcctggaccatgtgcccaggcctgtgtgctaggccctggggttgggattgcaaagaagactgtgtctcagtgagttcataatttggggggagagacacctctcccccagaaataaccagatatttccaggacagtttaacatgcctttcaaagctctttgacctttccaatatctctaaccacatctgtcatgatggagaatagatgggtgagagattggttgtatagatatatggatggaaggatggataaaatgtcagataatggataaatggatggatcaatagaagggtggatggatggctgtggacatgggaggttgaatggatggatggagggagggatgaatgggtgagtaggtgaatagattgtgggggttgggggtgggaatcattgaatgtgtgatttaggttcctggtcccacagcagatgaatataaggggaaagttccagtcctgcctcttgttcattgtgtgaccctgaagaattcacttctttagctgtagagtgagaatctgtctggaaagacctcacctatcaagtgagagtcatgagcccagcctgcatcccaggtctgttgtgggtatccagtgaaagaggtatggactgcccatgcctacataatggctgtgatgagtcctcagtcagtggcctcacaggcaccggcaacgtgaggtgtttttgctgagggagtgacgcccctctgtggttgctggtgtgttcctaggcttcccacttcctccagcctgcacagagttctctgcccagttaggagcaaaggaggtgacctctgcagaagtgttgctgccagaggctccccatacgctgtacttgtcaaggagtaattgaggtgtcctgtttgttattcatctcagggtaagagtaggctcagcaagggggcacccagggcttgggattagggctttggagttacatagatctgccttccagccttggctctgccacttcctagctgcctgacattggacaaggcatgagcctcagtttccccatttataaaatagtaacaaattatagtacctaccccttaggtaggttatgacaattaataagcataacttatgtaaccacctaacatagagctcagaatatattaaatgcatgtgtatccaagtgcagaattgcgcccttagaactttgaagaaaagtccaaaacttcaagtctagagacctccatcttgaatgctcagtccttggattagtttccttatttcaaaatgttcagtgggactgacattcttcttgacaagtgtgccttgactgaacagtgtctggttttggctgcaattccaggagttccatgggcctcgctgaccctgtcctgattacccttaggttaatagcagactgggcacatgaattatccctttaaaagtggtttgtgtgggagctacaaatctttccaatgggctgagctgtagggaggaggagaatttagaagggggtgtcctcccggggaagccgcaaagaccaggagagctggtcccacaggaccgaggctactcttgcagagacccagtgtggggacgatgccgtgggcggtggcaggccctgctggctcagggtgagctgcagccgatggcaaggggcccagaccacccaccagaaagaggccctgagtctgagtggccctaggcttgagtgggggcagtcctgacctgtagccctgaggacataactcgggaacaggtcattatgggaatgtctaagctccctcagtcccgaaatccccaactcaggctggctccggggccataccctccccagacccccattccttgcagggtccagatatcccccttggccagccccatctgcccatctgctcgctctgctatatgcctgcatggtatgtgcctgcgactgagactctgtgtcccttccattgggactgcaatcaagagagcttcctgaaacctggtggggccaggtgacaacagggaagtggctggttttccagaaagtgaaagagcaaagggttccaggctgggagcaggagtgataacaatgaagtcacagagtctgcagagcttgcattttgggagctggaaactcagggcaggttgattctgcctgtcgtaggctatctgagctgagcaggcccctcacagtcgatgggaagagaggaaagctgtccagggaagccaaggaagggacaggacttgcccaaggccacacagcgtgaatagcaaagctggggacaaagctgcccactgctacaacatcgggtagctgctccagccctttcctgccctgttggacatcatcagaaggatgtttaatcctcgctcctgtacatcctccatcccatgccactggacagctattcgatgggaccaaatttatcattagtacaggggcaatcaaaggagctttggggtccccaggaaggtggcctaggcccatcccaatgtccctgccttcctgccagtgggatccttcctgacagcccttctcaaagggacccagtgcggctcagcttggacccctgggaactacactggtgtgcaggaaagggtgagtctggattagtagcccggagagtgtgtccagcccatcactgtcttgggcaagttgctcctcctcttggacctcagttatctcatctgcccaatgggagtgaaaaccagagagaatttctagaaggcagttcctagcatggtatatttcttcacccaaaaatacaccccaactatcctcttctgccagcccgccctccccacaaatctctgcttcttggattaggctggtgccaagtgtaagtgaagcaaattagtttgtgtgcaaatcaattcctccagcttctgacagggtgatctcctgtgaatccctgtgcctcagtctgcagcctttaccaacccaggcagggagcggggccaggtggggctgaggcagtgcagcagagcagctggtgggggcagtcagtaggaaccagagcaaaggagttgagggcccatgcagccaggtcagccaggaggcatagaggtgactgtcggggcccaggcctagagacctagggtggatattcttgttgttcttgttgtttcttagttgctaagtcatgtccaactcttttgtgaccccatggactgaagcccaccaggctcctccgtccatgggattctccaggtaagaatacaggagtgggttgccatttccttcttcaggagatcttcccaaaccagggatcgaacccacatctcctgcattggcaggcaggttctttaccactgagccatctgtgaagcccacgggccaggaactaaaggaaattcatgtgtgtattggaacagttggcttgtgcagacagaccatgatcatgtcaaaggcaagggaagagggaataaagaaaactgctgtttttaactcggcttgattttctctacctggaaaccaatcttgccagtgaggtggtgctgttcccggaacgctttcagccgctaagaccggggttcgctcaggttcccaggtccggcgtctccatttcacaggagccctgctcgcccggctggagcagcgggcagggaaggagggaaactggagttgggcgcagcctcccaagctgaccctgccaggccgggcggtggcccctgtcctgtcgtcatcctcctttcacagcagagagggatcctgtctcctggtctcgttaattcttctatcatgtttcccagactcggagcctctggttgcctattgtcctgagcaggcattttgcatttatgtaaagattagacaggttagaaccttcgctctcactccgatggtcttttttactttctcaaatccaagttctttccttctcactgcgctctgcttccttattctctctctctccctacctgtctttatcagcctccctgtttattttcttcccttccctgaccccctccttctccccactgacctgcttttcctctgtcctctcttcacagttcagtagtttgaatcctctttctcccccctccaccaccgccaccacaaccctaaccttgcttaattccatatttatcttctcccggagcctcatagaaatgactgaaagcattgctcacctcattccagaaataactcttctaaattcttagagaggcaccgcacgggggagggtgtgagcactggacagggagtcactgtggtttactggagagaacaagacccaggttcctctgtgggctcttgggtacaccagctgtgtgaccgtgacaccgctggcctctggccagtctctgtttcctcccaggcagcagtggagctggcacccagatgagaacagctgtgtgtaaggttgtgaaggagagaggacggtggtgccctgcacacacacttgtgctctgaaatgtttttcctgcttccaccgcagcctgagccagtcggagggaaggaaggggatgctaactggtatctccctccttggttctgctctgctctacagggatcacacatgcgcgcacacacgaacatgccctgggaagaaacaaagctgtttcttcaccgtcatctatttctcccttccaaaatgtctaatggtaaaatcccaactgaacacaggagcaaaaacttgggctttagtgggttcctgaatttctccatttcaaatccaggccttcattcattcaccgccccctccctcggacagcactcactcagagtctcctactgtgtgccagacgggctccagggctggccttctctggagctctggacctcgagattgttggggagataagcccaatgtcatgagtcaggcatgagagagagcacgggttctgggagttccaagaaatgagagggcctttcctcttgtgcctggagacagggtccctgagaaggagggactctgagccagccgaggggcaggagcaggatgctggcccccagggagcccctccatcactctgccttttttgcagaaagtcacagaggtgagccaagacatcctgtcctggccaagatgggaggttttcccaggggcttttggtgtacatatccacaagccacctttctggaaagggctctgagggccccttcttagcatcaaggaaatctgtgggtcacataggttaagaagaaggaaagaagggcacttcctgggggaggtggggaggaggcggctccaggctggtcagtggtcaggggtaaactgtgtccttccctaaggaaagcaggcccagagaaggctctgactctcccaagtccacacagccttgtaggtcatttacctcccacgcagcagaagggacaccctccacctggttgacagtaggcagacaggaaagcagggtctcctccaaggaaagggagggttttgcccatgggacctctccctcccaactctgagctctgggcaagacccatggagagtggggaggggctcacggcatttggaggatgacttgagggggtccagtgggactgaaaggggtccctggggacagcacgggagcctcaggactccaggaggtgctccaggctcagagggagcatcctcccccctttttcctccctcatcctgccctcctccctaccgcagaggctggggcgggccgggcgccctgggaggaggcggtgtccctggctccctgcccaccggtgcagggctggacgggcaggggcggagccatgcctggtgttataagaggcagccagggcaccgaggcaatgagctgtcgctcagcttggcagcaggacgctggcagcaggcacactccgcactccagcccagcctgagcgtgcctcaccactgtggtcgccatgcccaccgccttgtgctccatcgctctagccctgctcgtggccctgcacgaaggtgagcaccccccacgggctcagcagctgcagcagccccgaggctgcttgtctgtatctcctgctggggctctgtgccccccaagccagccgggggccttcaggggcaggagttaggtggcttgggggctgcaggaggctgtgctattagaggtgctgccgtcccaggacagccaccggtccttccaacccagagctgctggggcttccccaggctggcccagggctcctgagcactgagaatgccaacttcctcgattatgcaagaggaggagcccagcgggtcccccatcccagctgtgccaggcgccctgacccacctctccacttttctctccctcctgtgcatgcaggcaagagccaggctgctaccacccccatcccagagcaaccagcgcccttgccccgggcccgaggctcccacctgcggactcgacgttgctcctgcagctcctggctcgacaaggagtgcgtctacttttgccacctggacattatctgggtgaacactcccgggtgagctactggagggatccaagaggggttgcagggggcaggggtggggaatgctggcatgctggggaagccctggcacactgcagctctctcttggagtgtggggctaacaacaatagcaatcagctattgcttcagttctcacgtgggggctgcctgagcaagacagagggctgtctcatgaaaatcctcacaaaaagcctggtcagaaagtgttggctccattttccagatcagggtactgaggctcagagaagttaggtgccttttccaaggtcacacaggaagagtaagtggtaggtaggaggctccagcctaggtctgcagatgccagagcgcacagcggctctgccatgctgcctctgtataatcttccaagaatgatatgattaatgacagcacccatgtcttgactgcgccaggccctatgccaagcactgctggtgcgttatcacctcgtgaacgcacccccatcctccccagtgaagcggggactgctgctgtccccaaatgacagacaagagacctgccccatgtcacctggcagagccggggtggggtcccagagctgtctgttctgtctgcacccgcgctgcctccgggccactgcatacttcaagttgaagtttctctgtgtgtttgtattttttttttccttctccaaattgcaaaagacaagagaagcccggcacgtaagcgtgtgtggagctaatccgcatccaaacactggctcagggcgggaaccctgccagtccctgcgtgctgggtctacctggagtctctgcagctccaaccacaccgtctaaaattagctcaggcatccgaggtgctggtctgaccggccacggggccctgcccttcgcctggcccgtctcagccagacggaatctgaaatcgatctcagccaatctaatatatctatgcacacacacgcacacgtgcaggtcaggcacacgcaccattttaaagtcaaaactctaagaaacacttgggtcacccttccaggcaagtggtgaccggatggaggcagctgagctgtgagcctgagtgttcacttctgtgagagggcactctctccctttcttccagactagttgggggtcttctttgagaacagggggaccagcctgactccatcagttcaaattgctgtctgggagtgagaggggcagggaggacagcttccacccctcccccccatgctgagcgtcttactgagcaggaccagggcagttgggagggaacagaggcccgagagggtaagggtcttgcccgaggctccctggcatgtaaggaggaagctgcagtgggaattcttgagggcaggagctggttacttttgctgccaccctggtggcatggatggctatcccagtgtgcagtgtggacagtcccagcttgccaatggtcctggtttatctaatcctctctctgtctctctccaccctacaccactaccttgctggcggcccgcccacagacagacagctccttacggcctgggaaacccgccaagacgccggcgccgctctctgccaagacgctgtgagtgctacagtgccagggaccccgcctgtgccaccttctgccatcaaaggccctggtaagtgggcacccagcctgcaaggggccagaggtgactgctggcctggacctgctctggagggcagggtgtctggaaggccagcagtggcggactgttagtccctaggtcgtgcccgactgtttgtgaccccacggactgtagcctgccaggctcctctgtctatgggattctccaggcaagaataccggagtgaattgccattcccttctccagggtgtccaggaggccagcagaggcgtggctaaatggtggaggaggggccaggggagcagggtcctgggggtccagaggctgccctgggctgtggggcagcctcccttcctgcagggagccagtcacccttgagtcttcccccctgccactacccccagctctgggggcttctgagaccattgcgtccccactcctgggcaggaggaatcctccccaggtgatagctgaggcagcacaggtccagagaggaaacaggacttgtcctgtcaggctacacagccagttagacgagagctgggccttccgccttagtcgctggggctctgggacctctggaactttctcagtggagaagcagtagctggagttggggggccatggcaccgtccccgagctgccacaaagcgcctttgccagtcttttggccctctggacctccctccctccacgcggagcgttgggaaagcagacagtgacttcaccctcccctacctcccgctctcatgaaggcctatgggaaactcctcccctgagacctcagctgtggctgcagccctgcctcagtttccctgctgagggttctgcttggctgcaagtggccagactctgggaaggccagccaccccactgcctctttctgaggctgagaacgcattcccagtggctcagttttcctcaggccccaccccacctgggaaaagaagggtgccaggtgcacagggtggaaatggatctgctcctgagggcgggtcggggcggggggctgggctgggcctgcagccaggcagcctgggggccctggacagcccctcacttgggccctaatgctgttcactcaggactgatgcggtggcagtcccaggcagcgggtcccctgcagctgcgttccaggatggcaagacacaggccacagcaggagagctcctccagcggctgaggtgaggggcccctacactgattgagtgccttctgtatgccttgcacatttcccttattctccatatgacgccttgggtccttatggggcagccaatagcagctcagacagatgaaggtgtttacccaaggtcacagagcaagctacagcatctggctgactcaatagcctgtgttcttaaccactatgctctttgttaccgccaggcctggaagtggacttttattgagggtttcaaggcttgtgactgtggaaggttcccaggtgttcattcaggctgtgtctgaatcaagcatctcccacatgctggggtccaaacggatgctacccagcctgttccctccctgggtcccagactggactgtctccctggtagctacaacatggctcagctcaaggcttggcatccaggaggtgcccatgaacgtgtgtccaaccaaactgacttgagaacagaaacctatagccagtcatgtggcagggtggctgaaggggcagcatctgagctagaaagtcccagccctgccacgagcaagctttgtgaccttggtctgctcactgaacttctctgtgcttctggttcctgtctgtgaggcagggacaccgctgctatccatctcacgggcttgttgaagtttagagcagttgacatacatgaagagccccaagaaagcccaggccctacgggagctctgaaggttttagccatcccgaacctctgtccctgagggttcctcagggctgcccagggccggggtgcagcctagcccctcaagggtccacatctctgtgaggaggcggaaacataggcaaaaagacaggatggccggctaggcaggacccaggatatactgaggaactatcttaaaaaaataataataaaatgaaagtgttagtcactcagtcgtgtctgactctttgcaaccccatggactatagctcaccagactcctctgtccatggaattctccaggcaagaatactggagtgggtagccattcctttctccagaaaatcttcccaacccagggatcaaacctgggtgccccgcattgcaggcagattctttatcatctgagccactagggaaacccaggaaatgtcttaagatgaaaaacttcaaggtaagactttgcaagtacttggcattccataattagcaaagagtgttttcgccagtctgtactcagcctcacaccagttcaggcctgtgtttattttacagaccaagaagggggttcagagaggttgagacccttgcccaagttcccaaagctgggaaccagcctcccagttcccaggctagaacgccttaagccagagtgaggccacctagatgacggcagagcccctaccagggtctcagccagattcaaaggactgctaggatccatacatatctggagctggaccttgaagaatgggaattttagggcacggagtatggggtgagtggaaggtcaacagcctgaagagccacagggatagaggtgtggaagtgagagggcaatcaggggagagccacggggctactcttggccgtgcagtcaccctggtggcacttgatgttgagcatcaattttgtcaaagctccttgtgggcagaaaagcttctaacctgccccggcctctccttgaggttcagaccttgttttcagggttggctgtgaccaccctctgacctcttggccatgaataaggaatccagaccctatgaccgctgcctctcatggggaactctcaagtgatgtatatctccagagatgctcaattgacctctttccatttcagggttatttctgcaaccaagatccactttgctaggcaacagcagaagccgacgagggagaccagacctacacactccaggcagaggaagagatagctctcgactctgggagaactttgggaaggaagcctgtgtggatacaggaggagaggggcatcccagagctgggagaccttccgacctgtttcctgggccagaaaacccagctgctggagcaggcacaagctctggcctcctcgccctggggagggggcctcgctcaaggcagctccgtgacaccaggaaagtcatcaggccccaggctgcagcgtggcctcccacactggctccagttcctaggccctgctgaaaggaacggcatgcggaatgtgctagcctggaggtgtcctgtctggcggctgtgaaccaggaacaacgtgcagtggcgggcactcacacccaagccagcccgagtccttccagggttgaagtcccggccgcccccgacccctcacccccgctctgtcccctccagccctcgctctccagtgtccttattctcccttcataccctcggggcactcttggtgagaagggcctgcaccacttcacctgtctgtatataacttatttgctctaagaaatttgacgattccgattatttattttaacgtatttttttagactctcaattatttacctgcgaacttgtgtttgtaataaacaacaaaataatgctctagcatttggtcttggttgagcaggaggtgggaggcacttttcaggaaggggctacttagaagtgaagggaacaaagggacggcggggaaagagcctgaggcaggtgtggagcactgagttccacacccctgtgccccggctgggcatcgctggctgctgacccaccctctctggacttttgcctatcatgtgcctagacagccatttgcagctttgatatcccgggttccaggacctgtgtttctatcaggccggtaagtgttggccaggcctttccccagagcatgtttcataggagccaagactataaggacccacttctgctctggttgccacccctgaggttcagagcaaacctgtccagtgagggctgtgtgctgttccaagactgtgtgcagccttactggccagggatggctgttgtaacggagtcacaggctggtccttatccctcaccctgggcttggacagaccccgctgggggcgctcaacacttctctcactaaagaagcccagggctctagcactggcttggctgatcctgccaaggccccaggaagctgctcacctgagtcccagggacagccagaagctacccccgctggcagctcctgagacctacagcctccactgctgccaaatccccctgcgaacaaactgttccctttcccctggccggcctctgctgggaatggtacgctgtggcctgagccagttattgaaaaataattatttacacactactctaagcctgccttgtccatggagccagccccaactccctcctgggagaagaacatgttgacgcatattgaactcctactgtttgctggcattttatgcagataaactcacttcatcctcatgacaatcccatgatatagatacttttattatccccattttacagatgaggaaactaatgcacagagaaggcaactaattttcctggggtctcgcagcaagtaagtggtagcatcaggatttgaacccagagtgtatagtacacatgtctatatgtactgactaaatatttgttgattgaattcatggattaccactgtagtatgacattgaacaaatcttcctctttctgagcctcagttttttaatctataaaatgggaaacagtactttccactttgtagagctggttgtgaaccctaaatggatgagttatggtgctgggctcagtcctgggcctgatgagaggcaaagccgaatgtcaggccgttagaagtgatgatgtaacaagagggacaggcacaaagctgcaggacctaagttggggggagattggggctggctggtgtgcagaggcatggtcagagaaagatgcacgactaaggtgccactcccacagcctaaggagagtgagactcacatcaatagaaggaaagtgaagagggagccccagacagagcagacaggaagggtaaaaggttttggcaatgggagtgacaaaggggtttcccatggaggaccccatgtggctggagcatggtggggagagagcagcaggagaggaaaccaggactccctggaggccaaagtagggagcctgcactttctctcatgggccatggggaccctcgaaaggtctgtgggcagcagggacctggtaaagccagactttgaaaaaatgccagagggccacacagggggaccctgaatggggagacagaaggcagggaagcaagtcaaccgctggtccttagggatccagcctgggtggctggggttggcgatggagccacacagtcacttcctacccaggattccggcacacctctgaaatctcactgagcctaacgccaggtgaatctcactccccagcatcctgttcaaaataaccctgcccccacggaaatcccaaagcaacggccaacagtcaggctaggcagtgatgtggggcaaccccagcatggcaggagtgatcgagaccaggtagaggaatgtaggttgaaggtgtgtccgaggcccagggaattaggcattcactgccctggtcagagttcagagatcagcgaccaaatgattaagtaagagacaattagagggaggcccagaaggcaggtgaaggcaaggcgataccataacccccaggatccttactctcaagaaatgggggcccctggcttgggccctgcactctagccctctgccagccatatctttctctccaaataagaagtttgcagggtgaagggtcatgaatacccaaagtctgagcctgcttctaaaccacattccatgcagcaggggcctcagaagtgtgggggaaggtgggatagagtttggaagaagcagaggaaaatttatgaagaactgttgccaaatcaaactgaaccctgggaagaaaggtgtcaacattttagaaagcatatctggattttatgggacaaaatcgtccctttttcctgcctttttctgccttttccataaatacttacaggtttggtttaggctttctgagttaaacttgtgttccttttaactggaacaccaggcggagataggccagaagggggcacagggtgacccagatttattcgggtcatgtgcatgcatggaagcagagtcagaggggagtggagttccatgtccaggactgtgcagcctgatacatatccaggctacagactggccctttcctgtcctggactgcctctccctccactctctcattcagcaaagaaccccaaggaactagtttcactcttgccatctcactctctctctgaacctcagggatttcaattgagaaaagtcatttgcctatcagggcaatgaatcattggagtgtggccatccatgcgttcaacaattatgaacaatcaccgttcagagactcccgtaaacaaggcagacacagcccctgccctcacaggccaagaggagagcctttcaataaagcactgttactatgaaggtagaagtgaaagcatttattgagtgctcatcaagctcttcttgcacatggattctttggatccttgcagcaaccttacacagcaggttctatcatcgctattcccagttgagagaagagataacggaggttaagcagctcacccaaagtctcatggctagcatgtggctgagctgggatttaaatctcaggctctcagcctgtctgctgtcctgctgctctaagcaggtagatccatacatagtgtgattgagcccctcgggtgggagagtctgggaggcttcctggaggaagtgacagttgatcaagagaaggagcgggtggacagagtgttcaggcagggggaacagtgtgtaggaagggagctatattctctgtgcttagtcattcaatcctatttgggacctcttggtctatagtccgttaggctcctctgtccatgggattctccaggcaagaatactggagtgggtagccatgccctcctccaggggatcttcccaacccagcgattgaacccaggtctcctgcattgcaggtggattctttaccagctgagctacccaggaagcccattctcagaccctatcagggaacaaaagaaggaggcatggggaagactggagaggggttgctagcggggtcgggggggtggtgggcatgcggctacaagcagggaaatccacagctgctgtcacctcacccccaatctgtgacagcctcagacaatgtccccctggacaatattgccatgcctgaaacacacctttggatcaaaccgtgcttgcgccccttggggtttccctaggctggcaaggaagacagacaaggcaaagtgaagagacaggaggtggataggttacgggctgcccttccagctgtgtgcccttcctgtctccctgggatctctgctcatttcatcccaggggcgttgtgggttcacagggaaagcttggggaaggagtagggtttgcacacactgggatgagggaaacagccggagcatagaagaatccgaaaagaggcagcaagcctgattggcaagggccaggctgggaacagcatgcagtgccaggaatttgaacttgagtgacggggagccagcgaaggtggctgatcaggggagagagccaggacaggagctggccttgggcagctggcttgtcctcggctcttcctgcctccccggccagtgcttccagctcaagggggccctcccagcccctcgcaggagagacaaagtgtgggccttgcctccgcctgccagggaccggagccaagagccctcagcagctcggaagggggccatgtgcgggcccgccaggagccctggaagaggaatgtggcctaattaattctccaaagctcagagggcctcgccttgtgggagcagctgccaggacaggcctgccaggacgccacaggcccagcccgtctatcattcagtgctcggggacagcaggctggaagcctggagacaggggcccagggggccagccccttgcctccaggtacacacgtgtcctccagccccttaacagaaaatagtgcgataatagtaataatcgccaacaggccttgagggcttaaaggtgtgtcagactctgtgcaaagcctgttatactcacttctcatctattcattacgaaggaccagtgacagggaaactgttaccatctccattttgcagatgaggaaactgagggacagatgggtgaatttccctggccgaaatcctgcaatcaaaaagcacacgcagggaagctaggattgggatgtaggcagcctgggccccacaagcatgttgtcataagcactgctgagccagcccagcgaggacatggaggcccagggtggagcgatacctttcccggggacagtcgactaaaaacaggccctgggacattgaatagggaagaaagaccacacccctgtcctctgcttgaactgcctcctcctgaagtttctcatagggcttttcctgtctcagcccgtaggtcatcctcaaagacatgtgactcgctactccaggcagatgggctggaagaagacatgccgtctccctgggatccctgctcatttcatcccggtggcgctgtggtggctgcactggcagctgggcgaggtggtctcacagcttcctcctagcccgctttccatccgtccacggaacacatcccctccaaggcgggctctgaatggtgcagggacggctgtaccagggccttccaactagaaagtggcagacccaggagaagatgggcacacagactggcccgaagccaagactctgctcttcctcagcagcagagcaggaggagggcagtgcagccacatcgcatcccctctctgggcctcagtttctcatctgctgtatgggcctaagagcattaactgtatagtcttgtcctgcattcatgcaggctaagttgcttcagtcatgtccgactctgtgcgatcctgtggactgtagctccccaggctcctcaatccatgggattctccaggcaagaatactggagtgggttgccatttccttctccagggggtcttcccagcccggggatggaacacatgtttcttacatcttctgcgttggaaggcaggttctctaccactagggccacctgagaagccccatagtcatgtcctggaactcattcatgtgtcaagtactgtccgaagtagtttacttaatttttaaaaattttccaaagcaaggttttttcatagctttgtaacatatcaccataaggctgcaccatatgcatctgttactctgtaggtgtgtattttagtttgtcccatttccctccaatgcaatgtttacatgtgtgctacatttatacacaaattttatattcattcctaattcttttttgctgcatattttttatggagacataatttacaccccataaaatccactcttttaaagtgtacaattcagggtttttttttaaatatattcacagttatacaaccatcaccactatctaattccagaacgtttccatcatcccaaaaagaaacacctcacctgttagcagttgctccccagatctcacttccccggcctctgtacaccacaaatctactttctgtcactatggatttgcctgttctggacattttatatcaatggaatcataacgtacgtggccttttgtgtactgctccgttcacttagcacaatgtcctcaagatttgtctatgttggagcaggtgtcgatacttcacgcttttccatgactgaataatattcccttatagagacagatcaggcttcccgggtggctcagtggttgagaatccccctgacaatgcaggagatgcaggagatgtgggtttgatccctgggtcgggaaaaacccctggagaaggaaatggcaacccactccagtattcttgtctgggaaatctcatgaacagaggagcctggcaggctacagtccatggggttacaaagagttgaacatgacttacaactgaacacacacacacacacagatcacattttgtttatccatttgtctgcgttgtttccactcttttggcttaagcactttactttagccttcagtgaccctatggggaggtgctctcttttcatcatataaacaacaagactgacatccagagagcttaagtaacccatgcaggtcacttagctagtgagcggcggtggtgggctttgccccaagagtctggctgcagagacagtggcctcaaccactgagcatcactttctcttcagtcagagtaagatagtataaatcagcacccacagcaactgtgccaaaagtggtacccacagggcacttaacagagggtggcttttctcagcagcatttctgacactggcagagccagggtctgccaggcagggcctgaagctggagcaagagtgtctggacagccagtgataatagtgactatctcagtacacgggtggttcttccagcaatggggacatctctccacacttggtggggggccgtgggcactgactcctctgctgcacatctctggcctgcaccccagagcccatctctcctcccacctccacctacaaagtcatggctcccctcctgtccccaaggccctgacactgagtaaccgaggcagcattcttgggtgaggtcaaggtcagagctgcagtggaggctgcatggacccttgaatgggtctctgtctcctcaggcctccacctactaaataattagataagaaatcttaatacttccttttttaattacaaagcaatttaaataggacaatatagacacaaaggcttgtggctttaagataatgaaaagactataggaacatctaaaataaaatgtctcttctgggcctcccactccaaggcaacgactctgagagtggggtaaatagccttttttttttctatgggttcagatatatgttttctatctaacgttttagaggtattaaaaataatgcacggcaacataagtttctctactttacaaccttttcttctcacaccaaaggcatctttccagaccaatacaaggcttttaccacctcttaattttaacagctccacgtggcccttgttaaggacaggcagttgtcacttgactgtccacccactgaagccttttggatggcttgcatttcttgttttcataagcacactacagtaagcacctggtttatacatctttgtctgcagaggacagatttttagacacgaaatttctaggtcaaaggatgagcacattttaagtattctgccgagaatgagattccaatttgcattcttgttcccactgggtatgagtgcccttttcctcacaagccttccagcactgggttttatccatctcttatcgtttgctgccctggtagcaaaaccacttcttcataaggaatacgatgtgcaaaagagctttgcttgatgccacccagggtgaggagggtgaggggtctggagatgctccaatgtctcactctgtcccctggtgcaaagaactcctctagggacttccagcactgctctccaggattctgtttggctctagggctctgtctctcagttccactcaggggttggccctcagggagctaagaatggaggaggggctggccagtcttcctgctcagttggccccagcctcccctaatagatgtgtctttgagtaggcgctcctggggacagcatcatcatgggaaagcgtgtgtgcgtgttgggagcggggggactctgggcacctgaacctgcagatgttcctaatgggggagcctggggcatcctggttccctctcagcctgccatccaaactcacgttttggaaaagactgaatctggatcttgcctctgcccaggtcttgctgtgtagacccaggcaggtcactgtcctttctggactccaggctcccggctgccaggctgggggaatccctttacagggtagatgccgaatctgctccctctggagactccacactggccacaccatgcgcatgagtcacccccaagttggcaggctgagggcaggggaggggcatggaggcaagagaagggaggctcgctccagatgactttggtgccacatggtgagtctggcgcagtggagtcttgcctggctaacgtgagtgtgtgagcacaggcacacagggcacaccgacgtgtgaagtgcattcttgtataccgaccggggatcctcctgctcaagtctgggcattcaggtttacagctcaggtgatgagtgtccatacacaatccatgtgtgtgcacattcttgtgcgtgtcaacacatacacgcatgtgtgcctgagtgcccctgagcttgtaaatcttcacctggttgtggctgcctagatgtgtctgcatgaacgtgtgaaagtgttagttgctcagtcatgtctgactctcctctgtccatgggatttcccaggcaagaatattggagtgggctctctggggcattttcccgacccagggatcgaacccttgtctcctgcattgtaggtggattctttactatctgagccaccagggaagcccagatgtgtgtgcacacatgtgcctaaatccgtgtgcatgcgtgagggtgcaggtgagcctgcaggatgtgcgcacacgtctatgattagagattacgggtgtgtgggtgcacaagtgtcacaaacatacacactaatgtgtgcgtttgtgtctgagcacatgtcaaaacacatgcatagagtatccgtagtgtagatggagtgcgtccacatgtatgggtctagaagggcttcagtgtgcatatgggcacagctatgtatgaactattacagtgtaactctgttgaagtgaatacacatgagtgtacatttgcacccaggaggggccacctcagcgtctgcaaactatgacatctcctccagggcccatcccacctggcctggacctctcccctcaacccacactgaggaaccaacagaaggacagtgtcattgctttaattacaggaagactaagtattttagtaattagtaagtcattataaagcttactgcttttaagaacaaaaatggctatattatagatacaaaatgcatatggaatctgaacaagaagcatggaagtgcaggattttccaccccaatctgggtgggagggcttgaagaccaagtatacacagggctcaggaaggcaagggagggagaggccagagcagagagcccctgcctccatttccaaggctgtccacacctgacctccatccctacctccatccagcgagatatcgttctgggcccagagggccccaaccctggcctgagtggaagtcagggagtgagtgtgtcagaccacctctgacagcaaccagtcaaggcaaggcccttctcattctcccttccgtggcctataactctaagatagtcatacctacctgggttttctcaaagaacctcaaaatataacctccaacacgtgcctacctccttcatcctcccagaacaatttctacctcccacccccagctcctgtccttctctcttggcctgcactgcctccttgccacaggtctgacccacaaacttctactcattggtccaaaaccacgcctgtgtcaccacccagctgtacaattgtcatcccagctggactgtgaactcctgaggtagggaaggctcaggcattcttgggtccccagagcccacctcaacctggcacagcttagatatcactcactatctgattttagaaactgagataagaggagaagaaagggagagcccctgggcgcagcaacgtttggtaaacacggcaggtcgttgggtgccccaagactggatgagtcagcctgacccttgccctggaggaggaagaaaaagtgtcatttatcaggctccacctggtgccagcatcagccacacacttgatccccaccacacacctgagaagtaagcaatatttttactcccattttatagatgcagaaactgaccctcacagaaagtgagtcagcagcagagctgggactcaagccttcctgactcagcacttcctacaggctcatccccccaggttctttctctctgnnnnnnnnnnnnnnnnnnnnnnnnnnnnnnnnnnnnnnnnnnnnnnnnnntcctcaggaacagcccttaatcataaaggattggggtggtgggtagatacgccagctcacttgcaccatgggtggagcaactctaaggctgcttccacaccctctcccggaggtctctggaggggctaagccctgtttccacctgttgctcattaacttgtctgtattggctgcgcttcctttctcccttccacatcttttatggatcttagaaccacctcgaaaataaactccatgccctcgaatcttagtccaggtcctctctggggaccccaacccaagaccaaggggcagcagccacagggactgtgagtctgggaaagccagggggacattcttgcaaagaggcctcggccacagaggcccagagacacatgcaggtccagacccatgggatgagccctggcaggcgggaggccagcctgactgcagctccagagctgcacacagtgtcaggctggcgcatgaggacgcaggagcaccagggtaaagagggcacgggtgtgagcacagcagctgatggcaacggggtttatctcagggcccaagaccacacccacacctccctcccttctgcagaaatgggcctggaacacctgtgccctggcaagccctagggtagaccccggctggaaaaccccagggctcccagctggccttctactgctcagcacctctggcctgggtcctggcagagcagggaggctgcctggggaaggtcttagatggcaaatctgtacaattctgtgcctctctgtccttcccattcaagaaatggcacagggccttggtagggccgaggaagtgaatggagggatcccagcacctcagagggcccctgttctctgactctgccaggacatagtttgcacacagaacattagatgtggcatatcttgcttccccacgcttttcagaagagggtgggcttccctgatggcactagtgttaaagaacctgactgccagtgcaggagatgtaagagatgtgggttcaatccttggatcaggaagatcccctggaggaggacatggcattccggtactcttgcctggagaatcccatgaacagaggagcctggtgggctacaggccatggcatcgcgaagagtcagacacgactgaagtgacttagtatgcacgcacattacttaacccagaggaatcaagttctaacggtggaaattcaagcattggaaaagacatggcttgattttaggagttggccttccctcaaatcacaccatgtcaaatctcagacaggcagcatcatgaagcagaaaaggcacaggctgtagagccagacagacctggctcaaatccttggagacagaaaagcccctcatcctgagctttggcttccttggctgtgaaataagttgacagtgtccactggcgggagacctggcttcagtccctgggttgggaagatcccctggagaaggaaaaggctagccactccagtattctggcctggagaatcccatggactgtatagtccatgaggttgcaaagagttggcactactgagcgactttcgctttcactttcactggccccaggtaagcatcttcaatctccttcagtcctcagtctggtgaggaagtaactccagagatgagcagatgggcactaaggcggccaactcctgctcaggtgggtccagagtgattcagaagcctgctgccccctgccaggggcctctgaggctgggctgtgccctgtccacttcaccctccccctgtgtggcccagccctgacccgagactcacccactgcccggtttcggcacctggcccacagttagccagggctgggtcttcagtatcaacattcctctgggataaatacctttggcctcaggaatgctgggaactgggccaagaggtcaaagggcctggactttatcctgagaagctcttaaagcctcacagcacctagacgaggcaggcgtagcccagtcataaagagaaactgagagccactgatttcatccaagaaaagaaaccaggggcctccttggttatcctccataagaatcaggacagcagaagatgaaaaaaatggactcaaagcaagcaacagactggaaattccacttctgggtatttaccccaaaggagtgcctagatatgttcatctgaagatacatacaaggttgttcacagcagcattgtttataatagtctcatactaagtgaagtaagccacaaacagaaagacaaatatatgattttccttatatggggtataagtgataccccatatatcgcttatacaaatgataaaaatgaacttatttgatgaaaaaaatgatacaaatgaacttctttgcaaaaccgaaacagactcacagagaacaaactatggtcactggagggaggagttggacatcagcatgtacacactgccgtgtttaaaataaataaccaacagggacctggtgtatagcacaaagaattctgctcaatacagtaataacctaaatgagaaaagaatttgagaaagaatagatgtatatatatgggcaactaaatcactttgctttacatttcaaactaacacaacattgttaaataactataggtaggtaggtagatttagttgctaagtggtgaccgaatcttgcctgccaggttcctctgtccatgggattctccaggcaagaatactggagtgggttgccatttccttctccagggatcttcccgacccaagaattgaacctgagtctcctgcactgcagtcagattctttatcaactgtgctatgagggaagaaaactccttaatgtaattaactatagttaacataattagtgagtgaagtgaaaattgctcagtcacgtctgactctttgcaactccgtggactatacagtccatgaaattctccaggcaagaatactggagtgggtagcctttcctttctccaagggatcttcccttaactagaagttaattaactaattagaagtaaatataattaactatactccaatataaaatttaaatatatactagaatgttcatagcagcactgtttataatagtctcaaactggaaactatgcaaaagggcagcaacagtagaatgaataagtaaattgatccctggtggctcagatggtaaagaatctgcctgcaatgcaggagacctggattcaatccttgggtcaggaagatcccctggagaggggaagggcaacaaactccagtatttttgcatggagaattccacagacagaggagcctggtggggtccttggggtcaaaaagagttggatacaactgagcaactaacactttctttcttcagattgaactacaactgataaaatcatacggatgatcttacaaatgaaacaagattccatcctttaagattccgtatgtctatatctatatccatgtatatctatatatctccagttttagtggtgccagaactcagcaaagtgatttcccttgggggaatgagggcaggcagtgactgaaagggaactggaagggagcctttggagaagcagtcatgttccattttttgatatagcttcagggtgcatgggtgttcttgttttgggaaaatccttcaagttgtacatttatgatctgtacacttttctatatgaatactatgctcttgaatcttgtgttggaatcttagcgatatgccctcttctacgtatggcctcttttgtgcaacattgtatttttgacattcatccatgttgtgacatgtaacaagatttcttctttttcactgccatgtagtattctattacccgaatagaccacaatgtgttcatccattctactgttgatggaaggtgggttgtttatggtctaggagctattacaaattagtgctgctttgaccattttttgtacctgagttttgatgaataaatgtacatatttctgctaggggtatacctaggggcgggatggctagctcatagaatatatacatcttcagctaacggcaccccactccagtactcttgcctggaaaatcccatggatggaggagcctggtaggctgcattccatggggttgctaagagtcggacacgactgagcaacttcactttcacttttcactttcatgcattggaggaagaaatggcaacctactccagtgttcttgcctggagaatcccagggacagtggggcctggtgggctgcagtctatggggtcgcacagagtcggacacgactgaagcgacttagcagcagcagtaatgctttggaaggaatggtgctaaagctgaaactccagtattttgggcacttcatgagaagagttgactcattggaaaagactctgatgctgggagagattgggggcaggaggagaaggggacgactgaggatgagatggctggatggcatcaccgactcgatggacgtgagtttgagtgaactcagggagttggtgatggacagggaggcctggtgtgctgcgattcatggggtctcaaagagtcggacacaactgagtgactgaactgaattgaactgaactgaatgattttccaaaatgttttaccattttggacttccatcagctgtgtatggcagcctcatattctcactagcacaagcacaagcatgctttgtcttgtagccattcaggcaggtgtgggataatttgcatttccctgctgcctagtgaagttgagcacctgtcttagtttgggttccctaggtggcgaccctgagacaaggatttgagagcaagaagtttcttggcaggtgtgttcgtctcctaaggctgctataacaaaataccatagactggtgtcaaaacaacagacctttattttctcacagttctgaggctagaagaccaaggtcaaggtgccatccacgttcgtttctggagaggcctctcttcctgccttgcagatggttaccttctcaccgagtcctcacatggttgcttctctgtgcatgtatagagaggcggagcaatatttctggtgtgtctttctcttgccttcaatgtaaggacaccattagggcctcaggcttatgacttggtttaaaccttaattatctccctaaagacctgatcaccaaatacagtcacttgggaaggtagggagacgtgattcagtccatcatagcaggcgatcctaggaaaactcacaagggagtgaagaagtgacagcatgcgggaggaggctctggaagtgcgtgtccacaagccagttgccaccctgggcatctggagttgaatcccacggggagattctgagaaaccacgtaaaccacgccctcgagagttatcccactcagggcgccggggaggtggacttctatacatcgactcctgccggtcactggttgaggcctatttcaaagtatgggggtgtggggtgggggcggtgatgttagctccctggtgcctcccaggctcacagaagccctgaggctcggagctgcgggtacacaggccacagcacgtcctcacatgctagtaacggtcgaatcctcacttgagtgaagtggttactcttttgaagctgagttttgaaggatgtatacagatgggccaggcaggagacagcattccagcagagggaacggtgnnnnnnnnnnnnnnnnnnnnnnnnnnnnnnnnnnnnnnnnnnnnnnnnnnggtcttccagggccccccagtcctctgactctcccaaatcctgactatgtactgcaagcaccactgaatgccagaatgtctcccatagccagagacatagacgaagttcccagcagagaggctgcaagccaggtcggggccggagcaaggacaaagggaccagcgttcccagggcaacagaggctcaggccacaggatgggcatcagagaagtcaaggcagatctcaaggttgacattaacaaaggaccttgagctaaggtatggggtcctgaagccctgagaaaggcccacttatactcacccccatgccacctgagttcagactgtgctgatcctcctcagtgtcctcccaggtccgaaaagctgtgcatgtttacactgtctgcagagcctaaaccaggaaggcagagggtcagggagaggcgggcccagggctgtgggcttggatgagaaccccctaaccaccattttgacctgaggggaactgggaagtgggaacctaagacaggtctgagcaggctctgactgctctgcagagctatcagcttggagtccagccacatccagttctgtatccaaataacaggcatctcatctgcagaagtataacctggcagggcccaggcatcgtgagtatctgtcagtccagccacactttggcaagtcatgtcccccctactaatcctgctctgtgtggcttgggtggggcagtctccccacacccaggcggcgggcttgtgaaccatgcctggccaaccatgtccccacccccaggtgccgtgattgactcaaggataaacccaggaccctacccaggccaacaggagtctcccttgagacttttactagcgatgtctggaaactctctcatctgctgagatcctgagctgtaaagaagagatgggaacagctggtggacagcttgcaagatagagaaaatctgcccagaataaaagaaagaaagaaaaaaaaaaaaaaaaaaaggcaggcctagctggaagatggagagagagagaaagagtctttgtggtgtcaattaaacacctgggtgcagcatgtctgaagttcctggactcctcatttgcatgagccaacacatttcctgctgcgtttatgtttcatcatggtttctgatgcttgcagtctgaaaggatctgatgaaaatactgggtgagaacacaaccagtgttcctttctgcaccttcatatctcagagatgtgcacggagtttctttaaaaagggcctttgcgattggaatgttgcagtgaggccaagatccctgtcatgctgcccttctttgccaaatgacaactaactgactcaaagtggagtaaacactgccaacagcttacattcaagagttcaggatgctactcccactggaagacctgtcctggaaagctgccctctgcctgactccccagagtattctggaaggtgcatttttctgaccaacagtcaggattaattactttttcatttgttgaaatatgggggtcagagttatatagacttaagagagagggaagaaaatagtgcatttttgcaactccagcctgaatgggcaatattgcacgttgcacgacttgatttgtttaattcaatgaagctcgacaatccacccaaatgtgtttaaccataggggtttggttaaataaattataatatatggattaaaaaagaagtaaggtagctctgaaatataccatcataaaaatatgtctcatgtatgaagtgttaagtgcactttgcacaatcacacctcaataaagtgaagttttttcaaaaatcaatttgcccaattatatgtataacatatgcccattaaaaaataatacaacagtcctataacttgcaaaagtttgtcatttatatgattaggtgggggaggtgggcaggaaaggaaggcgaaaacaatttgcaattaaagtaactcactctccttggatgattcagtccatgccagctttagttccctatcagagctatttccccttcacaagctatttcccaagacggaaagaagtataagcttgggaggctatgaactagaaacttgggcgtctaagaactagaagctgggatgtctttaggacttcagggaagagttcctccctggcctcacatctctcttgtaagaatgcctcatcctatgggttcagagtctcagttttcatcccagctgccattacctgtgcagcaggcagagcccagggctgattttaaccttgcaaagactgtagacgctccagaagaggagtgctgatcaggatccctgcagtctggctaggacttggggacattgtgaccctgtccagggtcctgactggcaagtgacacaccagaactcagtggctttctgtgtcccctgaggggctgggaaatcaaggcaaccccttcgcatcacacaggagacaagcgtgagactagagggtaccattcctggtcttctctctgcctgaacactctgtagtggcttgaatgctgacccctcagatgatatgtccacatccgaactcctagaacttgtggatgtgaattggccaaagggtctttgcagatacggggctgccctgatagctcagttggtaaagaatccatctacaatgcgggagatcccggttcaattcctgggtcggaaagatcccctggagatgggataggctacccactccagtatcctgttattcccttgtggctcagctagtaaagaatccgcctgcaatgcaggagacctgggttcgatccctggttgggaagatccttggagaaaggaaaggctgcccactccagtattctggtctggagaattccatggactgtacagtttatggggttgaaaagagtcggacacgactagtgactttcactttctttgcagatataattaaattaggtctcaagatgagatcatcctgaattatctggtggggggaggctctaaacccaatgacaagtggcctttcaagagaaagtccaaggaagatgtgacatagaagagatgagagatgactcagaggagaagaatatgtgaagacagaggcaaagactggagtgatggagccatacaaaatgccaccaactaccagacaccagaagaggcaagtaacaggctgccccctagggccggagcatagccctgccagtactgagatttcagacttctggcctccaaaactgtgaaagaataaatttttaaaccacttgttacggcaacccaagaaactcatgcacatttcctgctctcctttctactctactgtgggtatggaccaaatagccctccagacagcatcctacagagttctagaagtgggcagaagtcccctctggggtttctagcttttctacaaccgctcccaggctggggctcagagagaagggtgaggcacaggcagcctcttggcatcactctttcctcctacgaatctgtttttccagctctctaatggctcctctgagaaatggaagctctgcctacattattccgagctgggcaggcatttcaccctgcactgcaccataaattctttctacccgtgccttacagtaaaactccatgttcagtcctccaagtttgcgcctggcatctgcaggaagtcctgggagcagacaactctgctttctctcttatagtaggtgctgctgattctctacccaccttctctttccctgctccatctctttaaaatgacccagttttcattccggagtccatcttgcccttacatcacccacgtgcttcaggtgaggctaaccccaacctcagctctgggggctgctctaactggtggcatggaatctatcccacgtggtccagaaacccaagcctgagtgccagtgcagggcacctctccggccacagaaacaggcatgcaacaccagccatgatgccaagggaaatatactgggacctgctggaaacaggtatttccttgctgttagaaggatccaccagaagggacatgttctccttttcccttggtgtcctggtggtgaatgtctggcaattctgaggggagccaaccccaggatgaagccatcagacagagcatagccaaggggctgctgagttctaggccagagttgctggattaagccagtcctgaagcccaccctgtctctggaatctggttacctgagccaatacatctcattgttgaagccactgtgtcttagacttactgttacctgcatcccaaagcatcttgccaatataccacttgccacagccagttttttaagactactgtcctgttatgggttttgagatcctattttgggagtcaaaagctaactaagcattgttccttattcctcttacattattattgtagcaatttttaatcctccctaaggcagatggatgcctctggctcaataggaggaaaattcacataaggaagcttgagaaaaaatacacgttactgtatttcaaagaaatgatccacattaccctaacattcacacaaaaaacctgggggaagaacttctaaactgtgagcaggagcagctgaagaggacttgggggatatgtgtctccctttctaggctagtatcactgtaatgtttgaatttctagagtaagcatgtattacacttgtaatttaaaatcctgaggattagagtcatctgaggcatccagaattccccaggtaccgtccatggctcagctgtcaatcctgcagaaagtttatttgtggatcagagcaatgacttaagaagaatagtcacaatgtttctttacaatttagactttttgtttcaacagcgtacactgatctagctgagtgcatgttccccgccacaggaaacccttgccaaatctgtgccaagtggtagttaacaggactttggtgtctcctggggtcaggagaggggctgcagctctgagtcagccacagtctgcctcctcccttccaccccaggatctctggcacaaagcgcccatgcctctgtgaggtctgaagggcctccttgcaaactccaatcctgtgtttatgctcctcctgcaagaaggatgccacctcctccttggacagagatgaggaccttcagtatctccagaggggtctccagactctgggggccagagaccacagcccagaccccagtgccccgagagccccctgctctgccccagggtccccgtcactccctaggggttctcttctcggcttagtcctgatgcaatctccaagctcaactggcctgtctctgtcatttcccccaagctgataaagccagaaacctcagagtgagtggaaagagcctctgccctgaccagaagaaaccgcagggctgaccccataccccacagtaagagctggagaggctgggctctgggctcaacgcctggggagaggaggaagaaagatgaaagagctgaagaaaagaccatttgctatcacccgctcacacctgtccaccactctctcttccctggatctttccctgtgcttggtccctggactctgtccctctctaaagcttctggctccaggatcagaaaaagcctcagtgcgagcctcagttctagaatctcaactctcagaaaggctagtatagggggcctcagcactcccctgcccagacatgcctggggtaggtctgggattccttcatgctcacctcctccattaagggctgggcacccactagaaggcatcctgttccccatgggtatccagaaccctcaaatgtcccaaacctcctcatccaccctcacctctgcctggatgggcagtagataccccaggtctcttgccccagtcagacccctatgcaccaggccctgtgctgggcatcaggttcagagatgaggcaggtccctgctgcaggacagtggggggcaggggacagcaggtgggccaatggccagatgaaagcagtcacagtaactgccagctgctcggcccgatgccagctggggacgtgatattgaatggtcacgagccccttccccaacaagcagttcaagttcccagcagtggtctgtacagaagccctcgccagatgcagcatcgctcagagaggtcctcctggttcgcaggatttaacaagtaacccctgctccacggtcctatcgccctctagcattacgtgctcgatttgctcttccagtcacccactcccatcactggagtgtaagctcttggaggcagtatctgggtcattcttacaccccagaccctgggatgctgtctgggcactcacagtgtatttgtgggtactggatgtgcatgaaaggtggttgctggattcttgtccctccttctaccctatcagtcacctagccaaaccacccccaagacctgcagaagctgtctcttctgttctgtcatctctcctcctcgccctccccagactctaaacccagcctccccagcccttccttggtatttcttaatctctaactgctgctgctgctaagtcgcttcagtcatgcccaactctgtgcaaccccatagatagcagcccaccaggctaccccgtccctgggattctccaggcaagaacactggagtgggttgccatttccttctccaatgcgtgaaagtgaaaagtgaaaataaagtcgctcagttgtgtctgactcatagcgaccccatggactgcagcctaccaggctcctccgtccatgggattttccaggcaagagtaatggagtgggttgccatgctttctccgcctaatctgtaagcccagttcaaacgtcacctcctctgtgaagccagctcagatccctttgtgggcacattgcctgtcacatgatcctactgggcgctgcagccacgtgtttatgtgtctgcggcccccgcccccaccaccacctccactgctgaacagaagatcttcagaactgggctggggcccaggtctctgcgtccagggcttctacagagaccagggctgggcataatatcagagctcaggaacgatctgtcagatgaataaaggagtgagtggagaaatgaatggatgagcccccgttagtgagggatacgtgaaggagcaggcggatgcatgaatgagcaagggaagaagctaccgagtgaatgagtcagtgacttggggtgggggggagggggagtgagcctgtgaaggagagagagccgtgagggtttcagtccgctccagcagccctggcagcagccagcccccgccacccctgggcctgagctccgtgccaaccagacctcccgatgcctcctcccagagccagctgccgtcagcaccgctcagcacgcgctcccgatgctggccagcccctgcgctgggccatgaatcagacagggcactgccccagggctcccaggacccggggcagacagacagcctcataaataaacccgatgccctgctgggcagacatgtgttccagcagtgcagtgagctcagggttggctctggagccggggctggcagggcagagcctgatggagaagcctgggagagcctcaggaagagggacctcagggctgggcctggaggagaaagggcacccggggcaggagggctggcagcagccaaggcacagtggcttcgacagacacaggagtgcagggggagggcgtggtggaggtgggaacatggggaacgcagggcctgagtggtggggtcaagaagttgggattggcagagccagggctggggacacagcaggatgtaagcagagtggggcacaaggactgcgggctggcggtgctgtatctcagaaggaaagatgggaggctatggggaacaggtctgtgagtttctagggcgctcagggctgtgtcctgctatagctgttgcataattgagcttctggcttctctccacaaagtcaccatcatcctcccagccctaatactcaccaccagcagcttgaggctttggagcacccaaattagggaggttactttggtgagaacacttccaagtgggtgtttttaagccaagattgttttataatggttcagatcatggggaagatcctggggtttctgaagcaaatcagggaatttcagaatttgacaggaaacctcccagttgaatgggtggaggccaccaattcaaagatgctgagcatcctacagtgcacaggacagcccttcacgacaaagaatgacctagtctaagagatcaatcgtgccatggtgttcaactctttgcaaccccatggactgtaaccctccaggctcctctgtccatgggattctccaaggaagacgactggagcgggttgccattcccttctccagaggatcttcccaactcagggatcaaaccgggtctcctgcatcacaggcagattttttacctctgagccattgggaaagcccagtgtcgaggttaagcaacctgctttcacaggtgggaggactaagacggtgaggatgctagaccaaaaggtggtctccagtaattcacgtgggtcttcatacgtgccaggagctgttctgagaacctacccccattcactcatgtcatctcttcctgctttgaggatgaagattaaagacatatgtgattttcccagggtcacacagctggtgggtggtgaaggcaggattcccacccggattgtctggcttcaaatgctgtgctcttgatcatgacatcccatggtctcccacatcacccagcagctgggacagagctgggcttgggcccagagcccccctctccaggcagatgttccttccactctgctctgggccccaggtccatgtaggagtcttgggctcctccaccaccacagacgtggagcttagcaaccgggactttgatttgtgagggatgcagtgggtgggcaggaggcagatcccagggacagagggcctttgtctgcctgcagatgggcaggggccagttgggtgcaaactcattagacagctgccgaggctgccaaggagacgggagcaattagcgggcttggctgaagccaggaagtggaagccgctctgtgagagctgctgagcctccctgccctccaccaggacccagctccctaggaggcagctgccaagtttatgttcagtttgataatggcagctccaaccatccttacaggttgaacctactatgtgctgggctaggcacattccatatcttgtcttttttcatctataatcacccccacccaccttgggaggctggaatgactaactccattgcatccacttagtcatccttccattcattcgacaggtattcatttattgggtgcctactatgtgccagctctgtgctaggtcccagagatgcagcagccaacacagcagacaaaagtctccactccagtggaccttctgttctggaaggggaagacaggcaacaacaaaaaagaaacaaacaaggtaactgcaacttgtgatcagggctatggaggaagtgaaggggctgatgggaggatgctggggataaaggaatcagggaagctctctctaaggaggtgacagttcacaggggagggacttgggctccgagaggaaaggtgacttttccaaggtcacacagctggaaggtggaggagctagggcttgcctccagccttgacctgggcacctgcctcacaggagcccctgcccctccaccaggccaccatccacagctgtgccacacactggcaccgtatctccaccccttcctcatggcagcctcatgaaattcgtggggttatcacctccatcttacaggtggagaagaggcccagagggggccttcacaaacccagggccctgcaaaggaatgacagacaaggggcttgagcgtcttttgatccccaaacctgtattccttctgccacacctccatccttcctggccaagcacttgacgcgcactgagcgtttagtaggccgataagaaacagatggatgcatggactatggggccttgggcatcatctcctttcagtgcttccatttctccattagagaaggcgagagggtccagaccagcttcaaaatgcccaagttcattctactctgttgacattccttgaggagcgtggtcccctatggagaaaaagatgaaagggactctgcctcccgcagactattctgggcggagcaaactgcaggcagaagcatggaggtgggaaaggaaatggcgaggagtcagcagacatgtttaggacgcggagagccacctggaactcatatctaagtgtccctttccttttcctgcattcttaccacctgtcacctgcatagggtcttaggccaccagagcttcatctcctctcaattccagctcttgcttgagtcccagagagtctcccagaggaggggctgaagcagatcccaaatatatctgtgccaccaactgtgcacagtgtgatcttggtcaggcagctggtcccctccctcagccttggtcttcctatcgattaactggggagacagtgatcagagcaagtcggtagcacaataaaaggtgaggtttatgagcacattctccatgtcaggcagtcatcccttgagacaggcaattttgttatccctgatgtacagataagagatctgaggcttagggaggtgaagtcactggcccagggccacacactaggaaatggctcccccgggggattcacgcccaggtccatctgatgccagagctctgctcataacaaaaagctcatatgaagcaatgccctgccctttgacccacgcaacactcaacccccaggactttactcgtaggaaataatccaagagagccaaaaacctgttcacagcgggcctatttacagtatggcagatcactggaagaaatctgcatgcccaacgacagggctctgttcactttagaaattaggcagcttcagatggactgtggcttactgagcaccagctcttgccagttgctccactgtaacccccaccctaaccctgcaaagtggatgttgctttctgcatcctgggtgaggcctccaagttcagagtgtgaaggattggctgagggctcacagccagtgttgggccagggcatgagtggtgtggccaggcctgttcacagccacaccccaggtagctctgttctacaagaaaggaagctaaggcaagtaagtgacccagtaccacacggctgataagcagagaactggagtttgaccacaggaactgggactgcatactctgggaccacttccccacactgccacctactgactgggaaactgcaggcgagtcatttaccattcccaagcctcctgggctcctcatctgtaaaatgagaataagattgtctgttgcgcatggtgtcaccatgtaagcagtggtaaagatagcaatggcaacactggtaatactgctattcacagtcgataccaccgggacagcgttctgccgtgaaaggaaaccttgcctgaacgttagaaggactggctgcaaacctcagctaggacacgtctcaactctctctgggcctcagtttctccatctgtaaaatgggggagggcacacttgagcatgtctccggctctggtggtctctgagcccaggaacactgctatctcgggttttccctgggactctgcctgctgacccctcatcacacactggtctgggggagcgggggcgggacgcagtgggtctgggcttgaggacacatgtactggaggaggacaaggggcccttggacagggaaatggaggttaagtcaggaagccccaacactcagcccctcaacacacagcccctgctcctggcctaagggccactcaggcagcatctgctctaggtcctttgtacctctgcatgggacctgcctctgccccacggcctcagtctctcccctccctgccagcccctcaaggagatgctgaaccttggtgaagagaaagcagaggaaggcaaggaaggaaaggctgaggggaccaggagaagaggagaaagcaccctgagaaggaggggtgaagagcatggttttacataatggatggtaggggtgggatgagaacgaggcttgggacggggtagggaggaagaagaagaggtcaacagaggggctgagagggtctctgacatttttcagagttccctttaccaaccctggtgaccttcgggtgccctctctttatgtcctgctgactggatacactgggagccaggcctttcacagaggtcatgccagccctgagggcaggcctcccacatggctccagccccataggcggccacacagaagggccaagggatgtttgcgggacaaaggacttggttcactctcccaaaggctctgaactgagaagaatgtagacatcatccaatccacctttcctcacctgccgccccaccccacccccaccaagggaggaaggactttctcagggctccaaggtggggatgtcgatgtcagggccagaaccggaacccagtgtcctgtgtcttgggcctttctccagcccagccctggagggtcccagcagcaggaagaatccctgcctctggttctggcttaataaccagccacgaggcggggctcagggcctgcggctcagctgccagtctccccaggttgcaagagcattaaatggcctcagtgatgcacagctttgactcctgagcaggcgaggctggtggcagagaatacactgatgtgacatctgggggctcctgggagcctgagccccggacaaacctccaccagcgtctgaggaacctcaggctctgcagagtcagtggcacagaggcccgcagcatccttggaattgaggcctggtgtggcagaaagaggagaggccagatgacccaccgagataccccagaggcagcaaagctgagagacacagccagctgcaggttaagagctttcaaaaactttcagctacagccaaagacaggagatcagtttgtaaacagacaacaaaatcccacaacaccctcagatatgtcctaactcatctctctgatgggctcagagctggagctggcctgctcagattcctcatccctttccaagaaaggggcagcctagccttggacttggagaggccaatgccttcctcaggccagttcttctattccctccccatccaaatgcatcaacaaatcccctctgggtttattttcttccctccttccctgcaggactccagcctcatcccatcagtggtgctcacccttcctcccaaaccctccctggctccccatgtcaacaaggtggcattcagactacttgacttgacattcaagtgtgatctgctctctgacctcaaaccctactgctcccctctgccccaaccatgactctcagtcttgggatgttcttgccacaggaactgcacattccaatctggtagtgggcatgcttttcctctgaatgcaggtgacccatgcgtctgccccaatcagtggggccatggtagaggggactctcaaccctaccacttcctggaagtgtgaccttggggaagggagtctcacttttctcatctgcaaaatgggaatgctgatcccttcacgggattcaaaggtctgggcacagtgcagatcacagaactattattagctattatttagctattattggattccctgatagctcagttgataaagaatccacctgcaatgcaggagaccccagtacaattcctggatcaggaagatctgctggagaagggataagctacccactccagtattcttgggcttcccttatgactcagctggtaaagaatcctcctgcaacgcgggagacctgggtttgatccctagttgggaagatcccctggaaaaggctacccactccagtattctggcctggagaattccacggactgtatagtccatgggtcgcaaagagtcagacatgactgagcgactttcactttcactttagctattatttatcaggatcagtgctgttattacttcgtgcggtcccacacagcaaacatcctaagcaccgggccactggcaggccccaagtctgtcaaactaacctcacatgataatattagaaacactcgcctccatctcaacttgcatatgtgaaactgaggcccaggggcccaaagcccagctaacagcagaacagaccagaagccacatctcctgatttccaagccagaactctttccctacaagctgccactactaaaagccgagttcagacgccaaactttaattgtgatagtctcagtttatacaagaagaaaaacctttgctccatataagaatctttattatttattctcacttttaatgccccaccttgaacattcctatgtaccttcagagaacacccccctcctcctcctcctaggcaaagctcactcctccagctgctctttctccccacctcttttctctctccatccctggggaagcctttatctgaccttccctggcggagccaaagggcaaatgctggcttgcctttttgctgctcagctaaaaagctgactgccttttctcactttctggattgtgttgttgttcttagcctcaagggtctaccctgtaagagaaaaccagaacctccctctccaaagcctttatctattcccagttcctcccatcttaaaaaacaaccagggaccagacaaagcaaaccttcttctaccctcttctccttcagtctggcccggtttcttggtggtgacctgttatctccaggctccatctccttggcttcatctcctactcgccaacccatggggttgcctctgctgtgtcttctgttcaggtctgcagcgactccatttcccccaggtgtgctgggctctgggtagccttcaatctgcctgatctgtctgcctcagtttcctctctgagcgctgtctcctgggggttgtctgacactgtctccccacagccctgccagtaacttctcaatgccctttgttgggctcctcctccatccaagccttgacattctgtcttgggtcctcttgtcttcccatgctccttcccttggcctccttataggctgaatttccatctctagccaatgattgctagagtccacctccagcccaaacttttctcctgaggcccaggcctgggcaccctgttgcctctactggatgtctcttgtctttttaatgattatttatttgtttatttggctgcactgggtcctagttgaggcatgtgagcgcttagttgcagcatgtgggatctagttccctgaccagggatcgaacccggattgattgattgatccaggggtcaagacagggatcaaactctccattgggagtgcagagtcttagtccctactgggtgtctctaaggtagcatcaaccgagcacatctcaaatcatctcatcattttcttttgtgaaacccatctcccctcccgagcccccagctctacattcagccccaccacccaccctatctttgaagttgaacacctagaagtccctgatgtgtcctctttctcacccccacacccagtctgtcaccacaccctgctcagtccatcttccagaagcctgtacaacctgtccaggcgtcctgagtccaccacctcgacctcaatccaaacactccacttctcccctagtggagagtcctaacgggtctctcaaagccacacataccctgtactgcattctcacagcagccagaggggtctttctagaacacagatctttccatgtcatttccctacttaaaactcattactgtctgccaaatgttctccagtgaaacctccagatgtttggcgtctggtcgcaccctccccacccaccccccaaacccggccagctctctgagcacaaaccactctgtcttttcagctttttctttcaatttgctgtatttcttcctgcctctgaggctttgctgttgctgttttctctgtccagaatgcttctccttcagcatccccaccaacccatccttaagagatgaggccaagggttgcttcccaccttccccccagggcctctaggatttcgacagctgccaggctgtttgcgctcacccctgggagcttgtggttgcttgattcatgtctgtctgggctcctggactgcaaatcatgaaggccaggggccatgtctgtcttgctcatcctaaaaccacactgtgccaggcccacagcatcccacagccccacctgcccaagctacccccagtccacaaagccagcattaactgccccagagaccaactccaggctggaattcaaggcctcacccttccaaaactccccatccttaacccctcacacacaccttccccatccacactggggagcctcctctctcctccctttgctcccccccatttttccttcatccttctttctctaatgatattcaagctcaccattctccaatgatgcttctgttccctgaccacacagcccatcttattttggattgacaggcatcctccctagcttcaggatgaaattacaaggcacttgaggttctccataatctggctccggcctacactctcagatctccaccacccacacaagagtaatctggcacaagaggacttagccgttaaaggattcttggcctttctggattcaagccctgcttgcacttcttacaaacttcaggatcttgagcgagtactttgctaaacccctatttcctcacatgtaagacaggaacagttaagagtctccacctcattgaattctgtagagattaaataaggaaatccacaagaagtatttagcccagcacttggcaccaagaagctccaagctcctttcctctatcatggccctaattggttaagaacctgtccttcccatgggtcctatgttcagaggggatcctgggtgcctttcatctctgtttcccctttgcctagctcagtgcctggtcccaagaaaactcaataaatgcttattaatgcatagatagaccacacacttggcacaagtcatctcattgttcttcactttcatgtgtgtaaatcttatctctcctaacagagtttgagcttcagggtatgggggaggtggtgctgggagaaggtggtgaggtgtcttcatgtcagagcatccagaatgggagggatctctaagctcttgacatccctgtaccccccatggtgcccagcctggagcagggagtcatgaaggccttgttgacagatgggcctgtcatattccccaagaagaaggcacgtctcccgctccgagatatcgccctaattactccctggtccctcccctccacacacacatcggctttcttaggcaagagcctgcttgacttacacacatggagttcttttagctggtggttctgagccagctcagccagtttcttcagaaactacagcagaaagagaggaaaggttttttaaagccatagggcacaaaaccagagtgagggatgggtgaagtttccccagcaaaaggccagcaatggaccagcattggtcagatcatctcagcactgttccaaaggcaaacctgatggcatagtagaagggttaagtgtgtcgggctctgcactcagagactctcaggtttattccaggctttggccctaaccttctgggtgacgctgcacaattgacttaccctttctaagctcagttcccttggctatagagtggggacaatgttagtactaggaggatttaattagacaagatatcaaagggttggctatcactatgattatgatgatttttgtcattattattataataccattgaatataagatccagaaggaacctcaaaggtcatgtgagaggagagaacactgcagccagcagaggtggcctgactttgctaaaacatacagcagatcagtgcttttttctttacctctttcgctgacatctttcagagaaccaagggagtttgctcacttacccctgaccttggagttggtcccctaccttgacttgaagaacacagatttgggggtcttgaagccaacaacgaccaaaaaaatgggcattgttttcaccaatgggccctcgccagttggaggtggcccagccactgctgacaccatgctataggatggagcatggcctctacttgctatccatccttgaggaagggactgtgggctgggttcactataggcacagcctggacttgggaggcaaggcactgtctgctcccccttctccagctgagttctgcactctggcctctccttagcccggcccaggggctctgcctgcccacctgcctgccaaatggaatccctgcttccacccatcccaaatgcctcttccccactgccctccctctccctgaggctgggaaagacctggctggtccatctagaggatggcactgggcagggggcaaggcttagggagctgtggaaggccgctgccccgggtcaagaaggcaggtctccagcaatcttcaagggaggtgtgctctcagggctgaaggggagcccaacagcactgggagaaaaacaaaaacaggaaggcttgccatccagtaggcagctactctctccttggctcaaattacatgtcattccagtcaatcttggcaatagctccttctccactgggtggtttgtgagggcggagtgggaagctacatccacagcagagtacctggaaagaagaagcttgtgttaggggtgcacggtgagagaggctgccagctacttctctgtcgaagtactaacagaggtgccccttagaatagaccttccttgttcaggtacatctccctcggccagggtggaggaagcacgctcctctcaactccccaaacacaaagccaggaggtccccgtggcctgacaaaggcttctactactccattggctacagagctggcctcagaagcatcagtgggcaaatatgcatggggcccaaaaagcttccatgatcagggcctgcgtggggcacgcatgctcaggcactttagtcatgtctgactctttgcaaccctatggactgcagcccgccaggctcctctgtccatgggatcctccaggcaagattactggagtgtgttgccatgcccttctccaggggatcttccttaaccaggggtcaaacccacgtctcctgctttgcaggcagattctttaccaacgagccatcagggaaacccttctatgatcagcactgtgtcttaaaagttgggataacccattgtctagaaaagactccaaatagctggtcccctctccatgagggaagggagggtctgaaaggaggaccagattcagcacaatgtctgggattttggtaggagagctggttctggcttcccaagtggctgaagtagaagcctctcttggcctggcatggtggtttgctttgaggccaatggctaagaaagtgctaaccttggacccaaagtgcagagatcgcaggagcacaggctccactgaaaaggagaacaagggtccgtgaagctgagcagagcacgtcttccacagcgcccccattgtcagcagcagcagttagcactgatggcctggtgaggactagtttctctcttcctgacactggaagtaggagtcttctcttgggacagagaaaccttctgggtctttctggacaagggacggcaatggcttcagtcaggagacactgaacttccattaaattccacaggcagatatttgagcaattaactggaaaatgaagacttgagaccagtcctcccaaactagtgaggtgcatggttctggttattgcatagaacttgactatctcgttggttcctcataacagctcaacaagcaggcataattatacccactaaatatatgagaaaattgaggttccaaggagtcaaagacacgtgccagttcactcagctgggaagtgttggacctgggactggaatgatctctgctcagtgccccacgagattgaacagaaacctgaggacccagggccagcgcttctcatactgactctttcctatccttcagattacagtttaaccatctcctcctcaaagaggccgctgagccccagaacctgcagtgtgttccccccaccccatgacatctatacatctggacaatatttcttcctttcttagaatattatcataatgatcataacctcatttttacttgtggttttaaaatctctttgatctgcttctctctggagaatgttttccccacgagacagcacataatgtgcagtgtgcaccactgagccccaggcccagcacagggccgagcacatggtggaaccctgtatattgtttgaaggaatcattgagtagatggttaacgggtacttgaaagcatgtcctctttggatggcatgaaaaatcaagatgatcataagagagaggagaaaatccaggagagacacaagaccccatctccaaattctaaagggctgtcctgtaactataggaacaggtggggtgggaggcacaaaactggggttgctggaaagcaggactctcaatggttagggaaactgagcccctttcgaggctcctgccctgtataagcacaccctgaccatctatcccttcctgccccacctgggaaggactccagccatagctaaaggaggcttgtcaggcctgagtggtggctgctcagggactcaaagcaaagcaggttgttggggcgggctccaaggaggaggtgagctgcagggcttcctgggggattatcaggagcaaggatctctgggcagagacatgggtctgtctgctgaaacttgctcagagcagcttctgggcttcctggtcagataattgcaaacaaaatagaccagggactgggcagcagctacaaacccctcttatataagagaagggcctgggctgaggcatgcaggagcaggcagcagggccctgagtcatacaaggaacgagacccattcagaacagctaagattctggcctcagaagctttcagtgatgatgctggtggctttgcctttctctggccgcaggcttcccatttgcaaactgagaaccactggacatccactctgtacctggccagcactggggagaaggaggcattgacactacctcccagacacccaggaaggagcaccaactgacacactctggttcagacccggggtcagggaaaggcagtggggtagggggatcagcagagtacttccagaaagaaggtggaggacccatgctttaagctctttctctgtccctcttaaggaaactctgaccacccagaagagactggaaggtggccaagaaggatctagccgcaactggccagcagtacctgggactcaggtgcctgggtttcctcggggaagtgcacatttatgctcatttgtattatgctgcaatgtacatatatatatatgcaaatcacatatttgtgtgtttgtgtatgtgaatctctatactcctctgtgtgtgtttgcttctaactaggtttaattccaactctatgtgcccatgcatatgtgtgtgcccttgtatgtttctaggtatacacaggagtccaagtgattacgtaagttatacacatttattcattccagatatttatagggtgcccattacatgctacgtgttgtcctagggctgagaatgcagaggaaaaaattcaaggtctctttcctcatgtagtttgcctgcagcataaaagataagcaataaatgagggaataaacaaatgaataaataattgcagattgtgatcacttacatgaaagggaaaaaagcaggataattagagagtgacttgactttacataaagaggttaggaaagacagcttggaaatacagaaactcaggcctcaaacaagacctcctaattcagaatctgcattttaacaaggtccttagagggtctgcatgcacatcagacattaagaaactctcattaacatacacatgacatggaggacaaagggaatagaggcaaatgccacagatctccttctgctgctcgccatgagataatagttgggattcattgatcagtttccttcttccctgggcagaattctttgcccacaaaaatcactcaaggatctgaaaccttggaggccccgcccaactaaggctaccgcagtcttcagctgttgctgttcagtcatgtccaaccctttgtgaccccatggacttcagtaagccaggcttactgtctttcactggcgttccctgtctttctctacctcctggagtttgctcaaactcatgtccattgaatcagtgatgcagtcttcagttaacttttagcctaagacattttccacctctgttactcactgcccccactgagaatcagaaagctgatttccccatgacagaatcagtaaccccagtcacactgaaacccccttttctactagcttgcccaaagacataaggagttttcaatggtcagctggcgttcttaacttccacttgaatgcaaatattcttgcatcctctagtggaaacattccttccttgggcaccaaaacttctgaccccaagtttgaggggcaggtccttaggtgggattgtaggcactgccactgctccttctgctgctcagcccctggccctgtattccagctctgggagaaatagtaccatgtatagccagctgattaagagtgaatacagcatcttataggatgccccttccccaccaccaacatcacagtgtcttttaattccctttggctctgggacctagatttttattaggtcatttcataattttataggtccattgatttcttggtaatggggtacccgggatgaccaatggatccaattatcttcagtccattggcttactcctctccctgtaaaatggatttcttgatctacagcaatgttgtatgggatatcaagacagtggatgaggtattcatagagtctgcagatggttctgctggaagaattatggcaggcaggggaagcagatccaaatccagagtaagtagctgttccaatgaagaaaaattgctgttcctcccatgaaggaaagaatctgatgtcgtctccccctgaccacgtgacagccacagctgctttgtcactgagtccactgagcaagccctggggtgaccaggaaaagacaccaacaggcatccacaggaggtcatcttgaccacctgtttcttaaagccctttcttccagggtcttcaggtttcattcgagtgagtgttcttataggacacaagtaaactcgtgatgttggatccattctgagggtccaatcacatgccttttctccaagcttctctttcaccaacccttcagtcctgtctcttcccagtccctgtccctctgaccaaatcattagccacttcccatacatcactgtagaacataaacctctgttcttccagaccgagacagtgagacacaccaaagtgctgctcactgcggggatttctctattctgtcctccagggatacctctaaatggggctgtaattacacagcctcacactctactagcataacacgcagagccatttgttaagcaggctcagaatgcttttctcctccatacatgggctatagggaattcctgtgagagcgtaagtgtctgctgagaaagatgcagtatccagcaggtgtgagccacctcttatgcaacatgcttgtgctttcaggacctgcttgggtccagaccactttaccacctccactgaaggagggagtactgttgggtgtgctcagtttaatgggtaggtggacctgataacacagttgttctcttggactaaacgattgcatcatagtctatgctcaggtggttagcctctgttagtgccaaggggcaagccaagagtcatttctcaagaggtgaacatttgccagagaaggcatggtcttgctccaaaaatgaagcatctccagccatgatgctgctctctggtcttgccaaaagactccatgcagcatctcaatctgccacaaactttcagtacctttgaatctagtatattataaaaacttggcttgaagtcttaactagctcagatcccatttaaagccaacagcttttttgctcactcaggagctggcttgaagtagaagacacaagtgtggtagatgttgcctctaaaacccaaagcagcccaccgagtgataagtccctttcttagtgatctgcgatgtagagtgtcacagcctattcttcactttgaaggggatattctgaatttcccaggctgatattttcccagaagcttaattgagttccctgtattttctcagactatttttccttcaccatgcctctccaaatacaattgtatttcaagatacttattatcttatgatctctgtgtcctacgagtaagatatcaccaggacgtctctggcagtccagtggttaagactctgcttccactgcagggggtatgggttccatccctggttagggaactaaaatcccacatgatgcactgggcagccaaaaaatcaccagtgttctagatgaatgatgaaaagatcgatgtccctatgaactaactcgttagagggccagacgtgaaattagagttgacacagcatcatggcgaagtgggaggtgcactgctgttctgcctcgagaagtctacacacttttgatgtcctctgattattaccatagaggagtgaaagtattctctgagtgttaggtttgcattaatttgttatagccacaaaaccatacttgaagcatcatgggactataattggagttaccaatatatattaatgataacaatcccacgttaatttttaagacttatctatcttacgcattggtcaaactagaaaattttgaccttagccttaagctttgtggtcccaccaaagaagtgtcattgcactgacttactactttgatgttgtttgaaaacctacagtggctttcacttaggctccatgggtcagggagccagtgtagtaaatctgccaattctggggttgtctattctaactatacacttggaatctgggtaaataaccacagatagtactgctgtgtggtatggaagaggctcagatcaacattccaaattaaaaagtttatcttatccaaataaatccctaatctaatcaggtcagtctctggggtaactgatttctttagaaatactggagtgggttacccttttgttctccaggggatcttcccaacccagggatcgaacccgggtctcctgcattggaggcagaagctttaacctctgagccaccagggaagccccttcattcagggctagtatctactaattctcaaaatatctagggtctttgcctgtactctgttaccttgaaacatgaccacatatccctttggggaaggacaagagaagttttaaggaattaaattattacccaatgtgttattacatagtgtttcttcaagggggtcccctcctcttttatacaacagactgtttctgcttattgactaggggaggttctgaaaattttccattgtgatagttcagcttattttctactcataagatgcatgtctattttattatatgaatcaatatagggcttttgtgggctctccacctcttctggccttaaacccatgatcattaaccatgtccaaaaaataaagagtgccctgttgtttgaaccattccaattaccacgaggctctgctcactatgacggtcacacacccagcctctaacctcgaagtgccaccacatggtctctgccacactacgatcctcccatttccattgacaccagggacccattcagctatggcaggctctgccaggatgcctagctcacagagcacagccattga

SEQ ID NO: 49 - DNA, 33 bp, Artificial Sequence
  SNP208 PCR sense primer
atctcgagggagcccctccatcactctgccttt

SEQ ID NO: 50 - DNA, 33 bp, Artificial Sequence
  SNP208 antisense primer
ctaagcttggcgaccacagtggtgaggcacgct

SEQ ID NO: 51 - DNA, 36 bp, Artificial Sequence
  SNP272 PCR sense primer
atctcgagctctcgactctgggagaactttgggaag

SEQ ID NO: 52 - DNA, 45 bp, Artificial Sequence
  SNP272 PCR antisense primer
atgcggccgcattattttgttgtttattacaaacacaagttcgca

SEQ ID NO: 53 - DNA, 31 bp, Artificial Sequence
  SNP28 allele C sense oligonucleotide
aggattactcagacacagcctgggaaaaccg

SEQ ID NO: 54 - DNA, 31 bp, Artificial Sequence
  SNP28 allele C anitsense oligonucleotide
cggttttcccaggctgtgtctgagtaatcct

SEQ ID NO: 55 - DNA, 31 bp, Artificial Sequence
  SNP28 allele T sense oligonucleotide
aggattactcagacatagcctgggaaaaccg

SEQ ID NO: 56 - DNA, 31 bp, Artificial Sequence
  SNP28 allele T antisense oligonucleotide
cggttttcccaggctatgtctgagtaatcct

SEQ ID NO: 57 - DNA, 31 bp, Artificial Sequence
  SNP30 allele C sense oligonucleotide
gcgagggctgcactgcgggagtcagtttatc

SEQ ID NO: 58 - DNA, 31 bp, Artificial Sequence
  SNP30 allele C antisense oligonucleotide
gataaactgactcccgcagtgcagccctcgc

SEQ ID NO: 59 - DNA, 31 bp, Artificial Sequence
  SNP30 allele G sense oligonucleotide
gcgagggctgcactgggggagtcagtttatc

SEQ ID NO: 60 - DNA, 31 bp, Artificial Sequence
  SNP30 allele G antisense oligonucleotide
gataaactgactcccccagtgcagccctcgc

SEQ ID NO: 61 - DNA, 31 bp, Artificial Sequence
  SNP66 allele C sense oligonucleotide
gacctcgttgtccagcacgagactcagggga

SEQ ID NO: 62 - DNA, 31 bp, Artificial Sequence
  SNP66 allele C antisense oligonucleotide
tcccctgagtctcgtgctggacaacgaggtc

SEQ ID NO: 63 - DNA, 31 bp, Artificial Sequence
  SNP66 allele T sense oligonucleotide
gacctcgttgtccagtacgagactcagggga

SEQ ID NO: 64 - DNA, 31 bp, Artificial Sequence
  SNP66 allele T antisense oligonucleotide
tcccctgagtctcgtactggacaacgaggtc

SEQ ID NO: 65 - DNA, 31 bp, Artificial Sequence
  SNP78 allele G sense oligonucleotide
gatttggttcaacaagccttcaaaccacctt

SEQ ID NO: 66 - DNA, 31 bp, Artificial Sequence
  SNP78 allele G antisense oligonucleotide
aaggtggtttgaaggcttgttgaaccaaatc

SEQ ID NO: 67 - DNA, 31 bp, Artificial Sequence; identical to SEQ ID NO: 65
  SNP78 allele A sense oligonucleotide

SEQ ID NO: 68 - DNA, 31 bp, Artificial Sequence
  SNP78 allele A antisense oligonucleotide
aaggtggtttgaaggtttgttgaaccaaatc

SEQ ID NO: 69 - DNA, 31 bp, Artificial Sequence
  SNP80 allele G sense oligonucleotide
gatctgtcctgtgtcggggtcagaggcttgc

SEQ ID NO: 70 - DNA, 31 bp, Artificial Sequence
  SNP80 allele G antisense oligonucleotide
gcaagcctctgaccccgacacaggacagatc

SEQ ID NO: 71 - DNA, 31 bp, Artificial Sequence
  SNP80 allele A sense oligonucleotide
gatctgtcctgtgtcagggtcagaggcttgc

SEQ ID NO: 72 - DNA, 31 bp, Artificial Sequence
  SNP80 allele A antisense oligonucleotide
gcaagcctctgaccctgacacaggacagatc

SEQ ID NO: 73 - DNA, 31 bp, Artificial Sequence
  SNP105 allele G sense oligonucleotide
caaaaggctcccagtgtgtcttccaggtgct

SEQ ID NO: 74 - DNA, 31 bp, Artificial Sequence
  SNP105 allele G antisense oligonucleotide
agcacctggaagacacactgggagccttttg

SEQ ID NO: 75 - DNA, 31 bp, Artificial Sequence
  SNP105 allele A sense oligonucleotide
caaaaggctcccagtatgtcttccaggtgct

SEQ ID NO: 76 - DNA, 31 bp, Artificial Sequence
  SNP105 allele A antisense oligonucleotide
agcacctggaagacatactgggagccttttg

SEQ ID NO: 77 - DNA, 31 bp, Artificial Sequence
  SNP109 allele C sense oligonucleotide
tggcctcctggctggcgacggctgcctctct

SEQ ID NO: 78 - DNA, 31 bp, Artificial Sequence
  SNP109 allele C antisense oligonucleotide
agagaggcagccgtcgccagccaggaggcca

SEQ ID NO: 79 - DNA, 31 bp, Artificial Sequence
  SNP109 allele T sense oligonucleotide
tggcctcctggctggtgacggctgcctctct

SEQ ID NO: 80 - DNA, 31 bp, Artificial Sequence
  SNP109 allele T antisense oligonucleotide
agagaggcagccgtcaccagccaggaggcca

SEQ ID NO: 81 - DNA, 31 bp, Artificial Sequence
  SNP128 allele C sense oligonucleotide
ggtctgacaccagaaccagagaccttagcta

SEQ ID NO: 82 - DNA, 31 bp, Artificial Sequence
  SNP128 allele C antisense oligonucleotide
tagctaaggtctctggttctggtgtcagacc

SEQ ID NO: 83 - DNA, 31 bp, Artificial Sequence
  SNP128 allele G sense oligonucleotide
ggtctgacaccagaagcagagaccttagcta

SEQ ID NO: 84 - DNA, 31 bp, Artificial Sequence
  SNP128 allele G antisense oligonucleotide
tagctaaggtctctgcttctggtgtcagacc

SEQ ID NO: 85 - DNA, 31 bp, Artificial Sequence
  SNP137 allele T sense oligonucleotide
cctttttgatgggccttgagtttgggcaaaa

SEQ ID NO: 86 - DNA, 31 bp, Artificial Sequence
  SNP137 allele T antisense oligonucleotide
ttttgcccaaactcaaggcccatcaaaaagg

SEQ ID NO: 87 - DNA, 31 bp, Artificial Sequence
  SNP137 allele A sense oligonucleotide
cctttttgatgggccatgagtttgggcaaaa

SEQ ID NO: 88 - DNA, 31 bp, Artificial Sequence
  SNP137 allele A antisense oligonucleotide
ttttgcccaaactcatggcccatcaaaaagg

SEQ ID NO: 89 - DNA, 31 bp, Artificial Sequence
  SNP146 allele G sense oligonucleotide
ggcagccagagcagcggagcctcagagattc

SEQ ID NO: 90 - DNA, 31 bp, Artificial Sequence
  SNP146 allele G antisense oligonucleotide
gaatctctgaggctccgctgctctggctgcc

SEQ ID NO: 91 - DNA, 31 bp, Artificial Sequence
  SNP146 allele A sense oligonucleotide
ggcagccagagcagcagagcctcagagattc

SEQ ID NO: 92 - DNA, 31 bp, Artificial Sequence
  SNP146 allele A antisense oligonucleotide
gaatctctgaggctctgctgctctggctgcc

SEQ ID NO: 93 - DNA, 31 bp, Artificial Sequence
  SNP170 allele C sense oligonucleotide
aagggggtgtcctcccggggaagccgcaaag

SEQ ID NO: 94 - DNA, 31 bp, Artificial Sequence
  SNP170 allele C antisense oligonucleotide
ctttgcggcttccccgggaggacaccccctt

SEQ ID NO: 95 - DNA, 31 bp, Artificial Sequence
  SNP170 allele T sense oligonucleotide
aagggggtgtcctcctggggaagccgcaaag

SEQ ID NO: 96 - DNA, 31 bp, Artificial Sequence
  SNP170 allele T antisense oligonucleotide
ctttgcggcttccccaggaggacaccccctt

SEQ ID NO: 97 - DNA, 31 bp, Artificial Sequence
  SNP180 allele G sense oligonucleotide
tacactggtgtgcaggaaagggtgagtctgg

SEQ ID NO: 98 - DNA, 31 bp, Artificial Sequence
  SNP180 allele G antisense oligonucleotide
ccagactcaccctttcctgcacaccagtgta

SEQ ID NO: 99 - DNA, 31 bp, Artificial Sequence
  SNP180 allele A sense oligonucleotide
tacactggtgtgcagaaaagggtgagtctgg

SEQ ID NO: 100 - DNA, 31 bp, Artificial Sequence
  SNP180 allele A antisense oligonucleotide
ccagactcacccttttctgcacaccagtgta

SEQ ID NO: 101 - DNA, 31 bp, Artificial Sequence
  SNP181 allele G sense oligonucleotide
agtagcccggagagtgtgtccagcccatcac

SEQ ID NO: 102 - DNA, 31 bp, Artificial Sequence
  SNP181 allele G antisense oligonucleotide
gtgatgggctggacacactctccgggctact

SEQ ID NO: 103 - DNA, 31 bp, Artificial Sequence
  SNP181 allele A sense oligonucleotide
agtagcccggagagtatgtccagcccatcac

SEQ ID NO: 104 - DNA, 31 bp, Artificial Sequence
  SNP181 allele A antisense oligonucleotide
gtgatgggctggacatactctccgggctact

SEQ ID NO: 105 - DNA, 31 bp, Artificial Sequence
  SNP183 allele C sense oligonucleotide
gaggcatagaggtgactgtcggggcccaggc

SEQ ID NO: 106 - DNA, 31 bp, Artificial Sequence
  SNP183 allele C antisense oligonucleotide
gcctgggccccgacagtcacctctatgcctc

SEQ ID NO: 107 - DNA, 31 bp, Artificial Sequence
  SNP183 allele G sense oligonucleotide
gaggcatagaggtgagtgtcggggcccaggc

SEQ ID NO: 108 - DNA, 31 bp, Artificial Sequence
  SNP183 allele G antisense oligonucleotide
gcctgggccccgacactcacctctatgcctc

SEQ ID NO: 109 - DNA, 31 bp, Artificial Sequence
  SNP190 allele T sense oligonucleotide
ttttactttctcaaatccaagttctttcctt

SEQ ID NO: 110 - DNA, 31 bp, Artificial Sequence
  SNP190 allele T antisense oligonucleotide
aaggaaagaacttggatttgagaaagtaaaa

SEQ ID NO: 111 - DNA, 31 bp, Artificial Sequence
  SNP190 allele A sense oligonucleotide
ttttactttctcaaaaccaagttctttcctt

SEQ ID NO: 112 - DNA, 31 bp, Artificial Sequence
  SNP190 allele A antisense oligonucleotide
aaggaaagaacttggttttgagaaagtaaaa

SEQ ID NO: 113 - DNA, 31 bp, Artificial Sequence
  SNP208 allele T sense oligonucleotide
cttttggtgtacatatccacaagccaccttt

SEQ ID NO: 114 - DNA, 31 bp, Artificial Sequence
  SNP208 allele T antisense oligonucleotide
aaaggtggcttgtggatatgtacaccaaaag

SEQ ID NO: 115 - DNA, 31 bp, Artificial Sequence
  SNP208 allele G sense oligonucleotide
cttttggtgtacatagccacaagccaccttt

SEQ ID NO: 116 - DNA, 31 bp, Artificial Sequence
  SNP208 allele G antisense oligonucleotide
aaaggtggcttgtggctatgtacaccaaaag

SEQ ID NO: 117 - DNA, 31 bp, Artificial Sequence
  SNP264 allele A sense oligonucleotide
aggtcaacagcctgaagagccacagggatag

SEQ ID NO: 118 - DNA, 31 bp, Artificial Sequence
  SNP264 allele A antisense oligonucleotide
ctatccctgtggctcttcaggctgttgacct

SEQ ID NO: 119 - DNA, 31 bp, Artificial Sequence
  SNP264 allele G sense oligonucleotide
aggtcaacagcctgaggagccacagggatag

SEQ ID NO: 120 - DNA, 31 bp, Artificial Sequence
  SNP264 allele G antisense oligonucleotide
ctatccctgtggctcctcaggctgttgacct

SEQ ID NO: 121 - DNA, 31 bp, Artificial Sequence
  SNP272 allele G sense oligonucleotide
agccctcgctctccagtgtccttattctccc

SEQ ID NO: 122 - DNA, 31 bp, Artificial Sequence
  SNP272 allele G antisense oligonucleotide
gggagaataaggacactggagagcgagggct

SEQ ID NO: 123 - DNA, 31 bp, Artificial Sequence
  SNP272 allele A sense oligonucleotide
agccctcgctctccaatgtccttattctccc

SEQ ID NO: 124 - DNA, 31 bp, Artificial Sequence
  SNP272 allele A antisense oligonucleotide
gggagaataaggacattggagagcgagggct

The invention claimed is:

1. A method for culling, selecting, or breeding a mammalian subject, comprising:
    determining, using a biological sample from the subject, a presence or absence of at least one EDN2 gene mutation, or the genotype of at least one EDN2 gene single nucleotide polymorphism (SNP) selected from the SNP group consisting of SNP105 (nucleotide position 105,288,174 on BTA3 (UMD 3.1)), SNP208 (nucleotide position 105,298,664 on BTA3 (UMD 3.1)), and SNP272 (nucleotide position 105,305,070 by on BTA3 (UMD 3.1)), that segregates with resistance and/or tolerance to Map tissue infection, wherein said step of determining a presence or absence of at least one EDN2 gene mutation comprises
    extracting DNA from said biological sample,
    contacting said DNA to a probe immobilized on a solid support, and
    detecting the presence or absence of a DNA-probe complex;
    determining, based thereon, at least one of susceptibility, resistance or tolerance of the subject to *Mycobacterium avium* subspecies *paratuberculosis* (Map) infection; and
    at least one of culling, selecting, or breeding the subject, based on the determining of at least one of susceptibility, resistance or tolerance of the subject to Map infection.

2. The method of claim 1, wherein determining is of the genotype of the at least one EDN2 gene single nucleotide polymorphism (SNP), wherein
    with respect to SNP105 is of an infection susceptible allele (A)) and a non-susceptible allele (G), wherein
    with respect to SNP208 is of an infection susceptible allele (T) and a non-susceptible allele (G), and wherein
    with respect to SNP272 is of an infection susceptible allele (A) or a non-susceptible allele (G).

3. The method of claim 1, wherein the genotypes of at least two of the SNPs are determined.

4. The method of claim 3, wherein the genotypes of both SNP105 and SNP208 are determined.

5. The method of claim 4, wherein the genotypes of SNP105. SNP208 and SNP272 are determined.

6. The method of claim 1, wherein at least one of resistance or tolerance of the mammalian subject to Map infection is determined.

7. The method of claim 1, wherein the mammalian subject is bovine.

8. The method of claim 1, wherein said breeding comprises selective breeding to produce offspring having at least one of susceptibility, resistance or tolerance to Map infection.

9. The method of claim 1, wherein said breeding comprises selective breeding to produce offspring having at least one of resistance or tolerance to Map infection.

10. The method of claim 1, further comprising determining the genotype of at least one SNP selected from the SNP group consisting of SNP28 (105,279,109; BTA3 (UMD 3.1), SNP30 (105,279,358; BTA3 (UMD 3.1), SNP66 (105,284, 915; BTA3 (UMD 3.1), SNP78 (105,286,393; BTA3 (UMD 3.1), SNP80 (105,286,650; BTA3 (UMD 3.1), SNP109 (105288737; BTA3 (UMD 3.1), SNP128 (105,291,541; BTA3 (UMD 3.1), SNP137 (105,291,983; BTA3 (UMD 3.1), SNP146 (105,292,844; BTA3 (UMD 3.1), SNP170 (105,295, 131; BTA3 (UMD 3.1), SNP180 (105,296,189; BTA3 (UMD 3.1), SNP181 (105,296,223; BTA3 (UMD 3.1), SNP183 (105,296,667; BTA3 (UMD 3.1), SNP190 (105,297,461; BTA3 (UMD 3.1), and SNP264 (105,304,227; BTA3 (UMD 3.1).

11. The method of claim 10, wherein the genotypes of at least three single nucleotide polymorphisms (SNPs) are determined.

12. The method of claim 1, further comprising determining the genotype of at least one SNP selected from the SNP group listed in Tables 3A and 3B herein.

13. The method of claim 12, wherein the genotypes of at least three single nucleotide polymorphisms (SNPs) are determined.

14. The method of claim 1, wherein determining is of the genotype of the at least one EDN2 gene single nucleotide polymorphism (SNP) that is a causative SNP.

15. A method of selectively procuring or selling a mammal for commercial use, comprising:
determining whether a mammal to be procured or sold has been subjected to a method for determining at least one of susceptibility, resistance or tolerance to *Mycobacterium avium* subspecies *paratuberculosis* (Map) infection of a subject, comprising determining, using a biological sample from a mammalian subject, a presence or absence of at least one EDN2 gene mutation, or the genotype of at least one EDN2 gene single nucleotide polymorphism (SNP) selected from the SNP group consisting of SNP105 (nucleotide position 105,288,174 on BTA3 (UMD 3.1)), SNP208 (nucleotide position 105, 298,664 on BTA3 (UMD 3.1)), and SNP272 (nucleotide position 105,305,070 by on BTA3 (UMD 3.1)), that segregates with resistance and/or tolerance to Map tissue infection, wherein said step of determining a presence or absence of at least one EDN2 gene mutation comprises
extracting DNA from said biological sample,
contacting said DNA to a probe immobilized on a solid support,
detecting the presence or absence of a DNA-probe complex;
determining, based thereon, at least one of susceptibility, resistance or tolerance of the mammalian subject to Map infection; and
procuring, not procuring, selling or not selling the mammal based on the genotype of at the least one EDN2 gene SNP.

16. The method of claim 15, wherein procurement or sale is based on the presence of at least one non-susceptible allele selected from the SNP group consisting of SNP105 (G), SNP208 (G), and SNP272 (G).

17. The method of claim 15, wherein non-procurement or non-selling is based on the absence of at least one non-susceptible allele selected from the SNP group consisting of SNP105 (G), SNP208 (G), and SNP272 (G).

* * * * *